US011203783B2

(12) United States Patent
Suzuki et al.

(10) Patent No.: US 11,203,783 B2
(45) Date of Patent: Dec. 21, 2021

(54) T CELL RECEPTOR AND B CELL RECEPTOR REPERTOIRE ANALYSIS SYSTEM, AND USE OF SAME IN TREATMENT AND DIAGNOSIS

(71) Applicant: Repertoire Genesis Incorporation, Osaka (JP)

(72) Inventors: Ryuji Suzuki, Tokyo (JP); Tadasu Shini, Shizuoka (JP)

(73) Assignee: Repertoire Genesis Incorporation, Ibaraki (JP)

( * ) Notice: Subject to any disclaimer, the term of this patent is extended or adjusted under 35 U.S.C. 154(b) by 359 days.

(21) Appl. No.: 15/038,422

(22) PCT Filed: Nov. 20, 2014

(86) PCT No.: PCT/JP2014/005849
§ 371 (c)(1),
(2) Date: May 20, 2016

(87) PCT Pub. No.: WO2015/075939
PCT Pub. Date: May 28, 2015

(65) Prior Publication Data
US 2016/0289760 A1    Oct. 6, 2016

(30) Foreign Application Priority Data

Nov. 21, 2013 (JP) .............................. JP2013-241403
Nov. 21, 2013 (JP) .............................. JP2013-241404
Nov. 21, 2013 (JP) .............................. JP2013-241405

(51) Int. Cl.
*C12Q 1/6881*    (2018.01)
*G16B 30/00*    (2019.01)
*C12Q 1/6886*    (2018.01)

(52) U.S. Cl.
CPC ......... *C12Q 1/6881* (2013.01); *C12Q 1/6886* (2013.01); *G16B 30/00* (2019.02);
(Continued)

(58) Field of Classification Search
CPC .. C12Q 1/6881; C12Q 2600/16; G16B 30/00; G16B 20/20; G16B 20/30; G06F 19/30
See application file for complete search history.

(56) References Cited

U.S. PATENT DOCUMENTS

2006/0013817 A1    1/2006  Sahin et al.
2008/0166704 A1    7/2008  Marche et al.
(Continued)

FOREIGN PATENT DOCUMENTS

CN    102272327 A    12/2011
JP    10-229897 A    9/1998
(Continued)

OTHER PUBLICATIONS

Bolotin, D.A. et al, "Supporting information" for Eur. J. Immunol. 42:3073 (Jul. 2012).*
(Continued)

*Primary Examiner* — Diana B Johannsen
(74) *Attorney, Agent, or Firm* — Seed IP Law Group LLP

(57) ABSTRACT

The repertoire of the variable region of T cell receptors (TCR) or B cell receptors (BCR) is quantitatively analyzed using non-biased gene sequence analysis. The present invention provides the following: a method for quantitatively analyzing the repertoire of the variable region of the T cell receptors (TCR) or B cell receptors (BCR) of a subject by using a database, wherein the method includes (1) a step for providing a nucleic acid sample containing the nucleic acid sequence of T cell receptors (TCR) or B cell receptors (BCR) amplified in a non-biased manner from the subject; (2) a step for determining the nucleic acid sequence con-
(Continued)

tained in the nucleic acid sample; and (3) a step for calculating the frequency of appearance of each gene or combination thereof on the basis of the determined nucleic acid sequence and deriving the TCR or BCR repertoire of the subject.

8 Claims, 98 Drawing Sheets

Specification includes a Sequence Listing.

(52) U.S. Cl.
CPC . *C12Q 2600/156* (2013.01); *C12Q 2600/158* (2013.01); *C12Q 2600/16* (2013.01); *C12Q 2600/172* (2013.01)

(56) References Cited

U.S. PATENT DOCUMENTS

| | | | |
|---|---|---|---|
| 2009/0214550 | A1 | 8/2009 | Sahin et al. |
| 2009/0216638 | A1 | 8/2009 | Matthews et al. |
| 2010/0151471 | A1 | 6/2010 | Faham et al. |
| 2011/0003291 | A1 | 1/2011 | Pasqual et al. |
| 2011/0207134 | A1 | 8/2011 | Faham et al. |

FOREIGN PATENT DOCUMENTS

| | | |
|---|---|---|
| JP | 2004/187676 A | 7/2004 |
| JP | 2005-245381 A | 9/2005 |
| JP | 2006-166907 A | 6/2006 |
| JP | 2008-99588 A | 5/2008 |
| JP | 2009-11236 A | 1/2009 |
| JP | 2010-35472 A | 2/2010 |
| JP | 2012-508011 | 4/2012 |
| JP | 2013-524849 | 6/2013 |
| WO | 96/15238 A1 | 5/1996 |
| WO | 03/044225 A2 | 5/2003 |
| WO | 2004/033728 A2 | 4/2004 |
| WO | 2004/101815 A1 | 11/2004 |
| WO | 2005/056595 A2 | 6/2005 |
| WO | 2009/015841 A1 | 2/2009 |
| WO | 2009/137255 A2 | 11/2009 |
| WO | 2010/053587 A2 | 5/2010 |
| WO | 2010/151416 A1 | 12/2010 |
| WO | 2011/139371 A1 | 11/2011 |
| WO | 2011/139372 A1 | 11/2011 |
| WO | 2012/017081 A1 | 2/2012 |
| WO | 2012/038055 A1 | 3/2012 |
| WO | 2012/097374 A1 | 7/2012 |
| WO | 2012/140130 A1 | 10/2012 |
| WO | 2013/033721 A1 | 3/2013 |
| WO | 2013/043922 A1 | 3/2013 |
| WO | 2013/044234 A1 | 3/2013 |
| WO | 2013/059725 A1 | 4/2013 |
| WO | 2013/134162 A2 | 9/2013 |
| WO | 2013/169957 A1 | 11/2013 |
| WO | 2014/055561 A1 | 4/2014 |

OTHER PUBLICATIONS

Tabibian-Keissar, H. et al. Experimental and Molecular Pathology 94:182 (Aug. 2012).*
Shendure, J.A. et al. Current Protocols in Molecular Biology 7.1.1-7.1.23 (Oct. 2011).*
Evrogen, "Mint cDNA synthesis", 2 pages, downloaded Feb. 19, 2019.*
Knapp, M. et al. Methods in Molecular Biology, Ancient DNA, vol. 840, Chapter 19 (pp. 155-170), "Generating Barcoded Libraries for Multiplex High-Throughput Sequencing", online Dec. 8, 2011. (Year: 2011).*
Kitaura et al., "A new high-throughput sequencing method for determining diversity and similarity of T cell receptor (TCR) α and β repertoires and identifying potential new invariant TCR α chains," *BMC Immunology* 17:38, 16 pages, 2016.
Linnermann et al., "T-Cell Receptor Gene Therapy: Critical Parameters for Clinical Success," *Journal of Investigative Dermatology* 131:1806-1816, 12 pages, 2011.
Woodsworth et al., "Sequence analysis of T-cell repertoires in health and disease," *Genome Medicine* 5:98, 13 pages, 2013.
Adeegbe et al., "CD4$^+$ CD25$^+$ Foxp3$^+$ T Regulatory Cells with Limited TCR Diversity in Control of Autoimmunity," *The Journal of Immunology* 184:56-66, 2010.
Aihara et al., "Establishment and Characterization of Japanese Encephalitis Virus-Specific, Human CD4$^+$ T-Cell Clones: Flavivirus Cross-Reactivity, Protein Recognition, and Cytotoxic Activity," *Journal of Virology* 72(10):8032-8036, 1998.
Alamyar et al., "IMGT/HighV-Quest: The IMGT® Web Portal for Immunoglobulin (IG) or Antibody and T Cell Receptor (TR) Analysis from NGS High Throughput and Deep Sequencing," *Immunome Research* 8(1), 2012, 15 pages.
Benichou et al., "Rep-Seq: uncovering the immunological repertoire through next-generation sequencing," *Immunology* 135:183-191, 2011.
Betz et al., Passenger transgene reveal intrinsic specificity of the antibody hypermutation mechanism: Clustering, polarity, and specific hot spots, *Proceedings of the National Academy of Sciences* 90:2385-2388, Mar. 1993.
Brochet et al., "IMGT/V-QUEST: the highly customized and integrated system for IG and TR standardized V-J and V-D-J sequence analysis," *Nucleic Acids Research* 36(Web Server issue):W503-W508, 2008.
Carlson et al., "Using synthetic templates to design an unbiased multiplex PCR assay," *Nature Communications* 4:2680, Oct. 2013, 9 pages.
Collette et al., "ISEApeaks: an Excel platform for GeneScan and Immunoscope data retrieval, management and analysis," *Bioinformatics* 18(2):329-330, 2002.
Du et al., "Combined megaplex TCR isolation and SMART-based real-time quantitation methods for quantitating antigen-specific T cell clones in mycobacterial infection," *Journal of Immunological Methods* 308(1-2):19-35, Jan. 2006.
Eisenstein, "Personalized, sequencing-based immune profiling spurs startups," *Nature Biotechnology* 31(3):184-186, Mar. 2013.
Fugmann et al., "The RAG Proteins and V(D)J Recombination: Complexes, Ends, and Transportation," *Annual Review of Immunology* 18:495-527, 2000.
Fujii et al., "Analysis of T cell receptor repertoire in brain infiltrating T cells from mice infected with Japanese encephalitis virus," *The Japanese Society for Virology Scientific Meeting Program and Abstracts* 55, p. 360, Oct. 2007, with English translation, 2 pages.
Fujii et al., "Comprehensive analysis and characterization of the TCR α chain sequences in the common marmoset," *Immunogenetics* 62(6):383-395, Jun. 2010.
Fujiwara et al., "Analysis of T cell receptor in thymus from patients with myasthenia gravis," *Immunoneurological Disease Research Subcommittee FY 1998 Research Report*, pp. 100-101, 1999, with English translations, 4 pages.
Gaéta et al., "iHMMune-align: hidden Markov model-based alignment and identification of germline genes in rearranged immunoglobulin gene sequences," *Bioinformatics* 23(13):1580-1587, 2007.
Germain, "MHC-Dependent Antigen Processing and Peptide Presentation: Providing Ligands for T Lymphocyte Activation," *Cell* 76:287-299, Jan. 1994.
Giudicelli et al., "IMGT/V-QUEST, an integrated software program for immunoglobulin and T cell receptor V-J and V-D-J rearrangement analysis," *Nucleic Acids Research* 32(Web Server issue):W435-W440, 2004.
Hashimoto et al., "Analysis of TCR of tissue-infiltrating T cells in patients with pulmonary dermatitis associated with malignant tumor," *Annual Meeting of Japanese Society for Immunology and Academic Meeting Record* 28, p. 138, Oct. 1998, with English translation, 2 pages.
Hirokawa et al., "Delayed recovery of CDR3 complexity of the T-cell receptor-β chain in recipients of allogeneic bone marrow transplants who had virus-associated interstitial pneumonia: Moni-

(56) References Cited

OTHER PUBLICATIONS tor of T-cell function by CDR3 spectratyping," *Journal of Allergy and Clinical Immunology* 106:S32-S39, 2000.

Hirokawa et al., "Distinct TCRAV and TCRBV repertoire and CDR3 sequence of T lymphocytes clonally expanded in blood and GVHD lesions after human allogeneic bone marrow transplantation," *Bone Marrow Transplantation* 30:915-923, 2002.

Hirokawa et al., "Extensive clonal expansion of T lymphocytes causes contracted diversity of complementarity-determining region 3 and skewed T cell receptor repertoires after allogeneic hematopoietic cell transplantation," *Bone Marrow Transplantation* 27:607-614, 2001.

Hirokawa et al., "Oligoclonal expansion of $CD4^+$ $CD28^-$ T lymphocytes in recipients of allogeneic hematopoietic cell grafts and identification of the same T cell clones within both $CD4^+$ $CD28^+$ and $CD4^+$ $CD28^-$ T cell subsets," *Bone Marrow Transplantation* 27:1095-1100, 2001.

Hirokawa et al., "Reconstitution of T cell receptor repertoire after allogeneic hematopoietic stem cell transplantation," *Hematology & Oncology* 42(3):297-304, Mar. 2001, with English translation, 11 pages.

Horiuchi et al., "Identification of the T cell clones expanding within both $CD8^+$ $CD28^+$ and $CD8^+$ $CD28^-$ T cell subsets in recipients of allogeneic hematopoietic cell grafts and its implication in post-transplant skewing of T cell receptor repertoire," *Bone Marrow Transplantation* 27:731-739, 2001.

Hoshino et al., "Non-restricted T cell receptor (TCR)-V$\alpha$ and -V$\beta$ gene usage in patients with pulmonary sarcoidosis," *Clinical & Experimental Immunology* 108:529-538, 1997.

Jackson et al., "Benchmarking the performance of human antibody gene alignment utilities using a 454 sequence dataset," *Bioinformatics* 26(24):3129-3130, 2010.

Katamura et al., "Analysis of T cell receptor repertoires in a patient with Hyper-IgM syndrome complicated with lymphoproliferative disorder and treatment with bone marrow transplantation," *FY2000 Annual Report of the Research Committee of Primary Immunodeficiency Syndrome, the Research Group of Hematological Disorders*, pp. 31-36, 2001, with English abstract.

Kitaura et al., "A new method for quantitative analysis of the T cell receptor V region repertoires in healthy common marmosets by microplate hybridization assay," *Journal of Immunological Methods* 384:81-91, 2012.

Kitaura et al., "Development of TCR repertoire analysis method in common marmoset," *Japanese Association for Laboratory Animal Science Meeting Abstracts (Conference for Laboratory Animal Sciences and Technologies, KYUSHU 2012)* 59, p. 185, 2012, with English translation, 3 pages.

Kitaura et al., "Establishment of a new method for T cell receptor (TC) repertoire analysis and analysis of TCR with a variety of tissues from mouse," *The Japanese Society of Veterinary Science Scientific Meeting Abstracts* 140, p. 96, Aug. 2005, with English translation, 2 pages.

Klinger et al., Combining Next-Generation Sequencing and Immune Assays: A Novel Method for Identification of Antigen-Specific T Cells, *PLOS One* 8(9):e74231, Sep. 2013. (9 pages).

Kurane et al., "T-cell Responses to Dengue Virus in Humans," *Tropical Medicine and Health* 39(4 Supplement):45-51, 2011.

Lefranc et al., "IMGT, the international ImMunoGeneTics database," *Nucleic Acids Research* 27(1):209-212, 1999.

Lefranc et al., "IMGT®, the international ImMunoGeneTics information system 0," *Nucleic Acids Research* 37:D1006-D1012, 2009.

Li et al., "IMGT/HighV QUEST paradigm for T cell receptor IMGT clonotype diversity and next generation repertoire immunoprofiling," *Nature Communications* 4:2333, Sep. 2013, 13 pages.

Matsutani et al., "Alteration of T-cell Receptor Repertoires During Thymic T-cell Development," *Scandinavian Journal of Immunology* 64:53-60, 2006.

Matsutani et al., "Alternations of T cell receptor repertoires of CD4+CD25+ regulatory T cells and shortening of complementarity determining region 3 (CDR3) during thymocyte development," *Kaibogaku Zashi* 81(2):70, Jun. 2006, with English translation, 2 pages.

Matsutani et al., "Analysis of TCRAV and TCRBV Repertoires in Healthy Individuals by Microplate Hybridization Assay," *Human Immunology* 56:57-69, 1997.

Matsutani et al., "Comparison of CDR3 length among thymocyte subpopulations: Impacts of MHC and BV segment on the CDR3 shortening," *Molecular Immunology* 44:2378-2387, 2007.

Matsutani et al., "Detection of T cell clonality in leukemia cells using an adaptor ligation mediated PCR," *Annual Meeting of the Molecular Biology Society of Japan Program and Abstracts* 17, p. 409, Nov. 1994, with English translation, 2 pages.

Matsutani et al., "Determination of T-cell receptors of clonal CD8-positive T-cells in myelodysplastic syndrome with erythroid hypoplasia," *Leukemia Research* 27:305-312, 2003.

Matsutani et al., "Development of T lymphocytes and generation of T cell receptor repertoires," *Kaibogaku Zasshi* 81(Supplement):108, Mar. 2006, with English translation, 2 pages.

Matsutani et al., "Evidence for existence of oligoclonal tumor-infiltrating lymphocytes and predominant production of T helper 1/T cytotoxic 1 type cytokines in gastric and colorectal tumors," *International Journal of Oncology* 25:133-141, 2004.

Matsutani et al., "Increased Positive Selection Pressure Within the Complementarity Determining Regions of the T-Cell Receptor $\beta$ Gene in New World Monkeys," *American Journal of Primatology* 73:1082-1093, 2011.

Matsutani et al., "Molecular analysis of T cell receptor V$\beta$ chain to detect leukemia cell clonality in patients by adaptor ligation-mediated polymerase chain reaction," *Journal of Immunological Methods* 177:9-15, 1994.

Matsutani et al., "Replacement therapy with plasma-derived factor VIII concentrates induces skew in T-cell receptor usage and clonal expansion of CD8+ T-cell in HIV-seronegative hemophilia patients," *Thrombosis and Haemostasis* 90(2):279-292, 2003.

Matsutani et al., "Restricted usage of T-cell receptor $\alpha$-chain variable region (TCRAV) and T-cell receptor $\beta$-chain variable region (TCRBV) repertoires after human allogeneic haematopoietic transplantation," *British Journal of Haematology* 109:759-769, 2000.

Matsutani et al., "Shortening of complementarity determining region 3 of the T cell receptor $\alpha$ chain during thymocyte development," *Molecular Immunology* 48:623-629, 2011.

Matsutani et al., "Skew in T-cell Receptor Usage and Clonal T-Cell Expansion in Patients with Chronic Rejection of Transplanted Kidneys," *Transplantation* 75(3):398-407, Feb. 2003.

Matsutani et al., "T cell receptor repertoire in thymic T lymphocyte subpopulations," *Kaibogaku Zasshi* 80(1):13, Mar. 2005, with English translation, 2 pages.

Mori et al., "Next generation sequencing: new tools in immunology and hematology," *Blood Research* 48(4):242-249, Dec. 2013.

Nagaoka et al., "T cell receptor variable region repertoire in mouse infected with influenza virus," *The Japanese Society for Virology Scientific Meeting Program and Abstracts* 56, p. 200,Oct. 2008, with English translation, 3 pages.

Ohm-Laursen et al., "No evidence for the use of DIR, D-D fusions, chromosome 15 open reading frames or $V_H$ replacement in the peripheral repertoire was found on application of an improved algorithm, JointML, to 6329 human immunoglobulin H rearrangements," *Immunology* 119:265-277, 2006.

Pannetier et al., "Quantitative titration of nucleic acids by enzymatic amplification reactions run to saturation," *Nucleic Acids Research* 21(3):577-583, 1993.

Pannetier et al., "The sizes of the CDR3 hyperyariable regions of the murine T-cell receptor $\beta$ chains vary as a function of the recombined germ-line segments," *Proceedings of the National Academy of Sciences* 90:4319-4323, 1993.

Pham et al., "Half of the T-cell repertoire combinatorial diversity is genetically determined in humans and humanized mice," *European Journal of Immunology* 42:760-770, 2012.

Robins et al., "Overlap and effective size of the human $CD8^+$ T-cell receptor repertoire," *Science Translational Medicine* 2(47):47ra64, Sep. 2010, 9 pages.

(56) References Cited

OTHER PUBLICATIONS

Rogosch et al., "Immunoglobulin Analysis Tool: a novel tool for the analysis of human and mouse heavy and light chain transcripts," *Frontiers in Immunology* 3:176, Jun. 2012, 14 pages.

Saitoh et al., "The presence and longevity of peripherally expanded donor-derived TCRαβ+ mature T lymphocyte clones after allogeneic bone marrow transplantation for adult myeloid leukemias," *Leukemia* 17:1626-1635, 2003.

Sakaguchi et al., "Altered thymic T-cell selection due to a mutation of the ZAP-70 gene causes autoimmune arthritis in mice," *Nature* 426:454-460, 2003.

Sakata et al., "Analysis of human T cell receptor (TCR) with adaptor ligation PCR method," *Annual Meeting of Japanese Society for Immunology and Academic Meeting Record* 22, p. 466, Oct. 1992, with English translation, 2 pages.

Sherwood et al., "Deep Sequencing of the Human TCRγ and TCRβ Repertoires Suggests that TCRβ Rearranges After αβ and γδ T Cell Commitment," *Science Translational Medicine* 3(90):ra61, 2011, 8 pages.

Six et al., "The past, present, and future of immune repertoire biology—the rise of next-generation repertoire analysis," *Frontiers in Immunology* 4:413, Nov. 2013, 16 pages.

Souto-Carneiro et al., "Characterization of the Human Ig Heavy Chain Antigen Binding Complementarity Determining Region 3 Using a Newly Developed Software Algorithm, Joinsolver," *The Journal of Immunology* 172:6790-6802, 2004.

Suzuki et al., "Research on establishment of early defense method for the infection changing due to global warming," *FY 2008-2010 Research Report*, pp. 88-97, 2011, with partial English translation, 11 pages.

Suzuki et al., "Research on establishment of early defense method for the infection changing due to global warming," *FY 2010 Summary/Sharing Research Report*, pp. 79-82, 2011, with partial English translation, 5 pages.

Suzuki et al., "Study on the establishment of comprehensive measures against mosquito-borne viral infection whose entry into our country is feared," *FY2011 Summary/Sharing Research Report*, pp. 39-41, 2012, with English translation, 5 pages.

Thomas et al., "Decombinator: a tool for fast, efficient gene assignment in T-cell receptor sequences using a finite state machine," *Bioinformatics* 29(5):542-550, 2013.

Toyosaki-Maeda et al., "Presence of rheumatoid arthritis (RA) synovial autoantigen recognized by T cells in RA joints," *Japanese Journal of Rheumatology* 9(4):313-324, 1999.

Tsuruta et al., "Analysis of the population of human T cell receptor γ and δ chain variable region subfamilies by reverse dot blot hybridization," *Journal of Immunological Methods* 169:17-23, 1994.

Tsuruta et al., "Detection of human T cell receptor cDNAs (α, β, γ and δ) by ligation of a universal adaptor to variable region," *Journal of Immunological Methods* 161:7-21, 1993.

Tsuruta et al., "T cell receptor (TCR) analysis in local lesions of patients with rheumatic arthritics," *Annual Meeting of Japanese Society for Immunology and Academic Meeting Record* 24, p. 501, Oct. 1994, with English translation, 2 pages.

Van Heijst et al., "Quantitative assessment of T-cell repertoire recovery after hematopoietic stem cell transplantation," *Nature Medicine* 19(3):372-377, Mar. 2013.

Venturi et al., "A Mechanism for TCR Sharing between T Cell Subsets and Individuals Revealed by Pyrosequencing," *The Journal of Immunology* 186:4285-4294, 2011.

Volpe et al., "SoDA: implementation of a 3D alignment algorithm for inference of antigen receptor recombinations," *Bioinformatics* 22(4):438-444, 2006.

Von Boehmer, "The Developmental Biology of T Lymphocytes," *Annual Review of Immunology* 6:309-326, 1988.

Wakasa-Morimoto et al., "Arthritis and pneumonitis produced by the same T cell cones from mice with spontaneous autoimmune arthritis," *International Immunology* 20(10):1331-1342, 2008.

Wang et al., "Ab-origin: an enhanced tool to identify the sourcing gene segments in germline for rearranged antibodies," *BMC Bioinformatics* 9(Supplement 12):520, 2008, 9 pages.

Wang et al., "High throughput sequencing reveals a complex pattern of dynamic interrelationships among human T cell subsets," *Proceedings of the National Academy of Sciences* 107(4):1518-1523, Jan. 2010.

Warren et al., "Exhaustive T-cell repertoire sequencing of human peripheral blood samples reveals signatures of antigen selection and a directly measured repertoire size of at least 1 million clonotypes," *Genome Research* 21:790-797, 2011.

Ye et al., "IgBLAST: an immunoglobulin variable domain sequence analysis tool," *Nucleic Acids Research* 41(Web Sever issue):W34-W40, 2013.

Yoshida et al., "A new method for quantitative analysis of the mouse T-cell receptor V region repertoires: comparison of repertoires among strains," *Immunogenetics* 52:35-45, 2000.

Yoshioka et al., "Analysis of the population of human TCR α and β chain V region subfamilies by reverse dot blot hybridization," *Annual Meeting of the Molecular Biology Society of Japan Program and Abstracts* 17, p. 408, Nov. 1994, with English translation, 3 pages.

Yoshioka et al., "DS-Nh as an experimental model of atopic dermatitis induced by *Staphylococcus aureus* producing staphylococcal enterotoxin C," *Immunology* 108:562-569, 2003.

Yoshioka et al., "Impact of T-cell receptor Vβ haplotypes on the development of dermatitis in DS-Nh mice: synergistic production of interleukin-13 caused by staphylococcal enterotoxin C and peptide glycans from *Staphylococcus aureus*," *Immunology* 121:51-61, 2007.

Yoshioka et al., "Polyclonal expansion of TCRBV2- and TCRBV6-bearing T cells in patients with Kawasaki disease," *Immunology* 96:465-472, 1999.

Yoshioka et al., "Quantitative analysis of the usage of human T cell receptor α and β chain variable regions by reverse dot blot hybridization," *Journal of Immunological Methods* 201:145-155, 1997.

Yoshioka et al., "Relation of Streptococcal Pyrogenic Exotoxin C as a Causative Superantigen for Kawasaki Disease," *Pediatric Research* 53(3):403-410, 2003.

Yoshioka et al., "Spontaneous scratching behavior in DS-Nh mice as a possible model for pruritus in atopic dermatitis," *Immunology* 118:293-301, 2006.

Yoshioka et al., "Streptococcal disease and Kawasaki disease," *Clinical and Microbial* 27(4):381-389, Jul. 2000, with English translation, 12 pages.

Bolotin et al., "Next generation sequencing for TCR repertoire profiling: Platform-specific features and correction algorithms," *Eur. J. Immunol.* 42:3073-3083, 2012.

Freeman et al., "Profiling the T-cell receptor beta-chain repertoire by massively parallel sequencing," *Genome Res.* 19:1817-1824, 2009.

454 Sequencing System: Guidelines for Amplicon Experimental Design, pp. 1-54, 2012.

Coppage et al., "In vitro generation of tumor specific T cells that recognize a shared antigen of AML: Molecular characterization of TCR genes," *Leukemia Research* 31:195-202, 2007.

Jorritsma et al., "Selecting highly affine and well-expressed TCRs for gene therapy of melanoma," *Blood* 110(10):3564-3572, 2007. (10 pages).

Zhao et al., "High-Efficiency Transfection of Primary Human and Mouse T Lymphocytes Using RNA Electroporation," *Molecular Therapy* 13(1):151-159, 2006.

Ko et al., "Unbiased amplification of a highly complex mixture of DNA fragments by 'lone linker'-tagged PCR," *Nucleic Acids Research* 18(14):4293-4294, 1990.

Linnemann et al., "T-Cell Receptor Gene Therapy: Critical Parameters for Clinical Success," *Journal of Investigative Dermatology* 131:1806-1816, 2011.

\* cited by examiner

Fig. 12

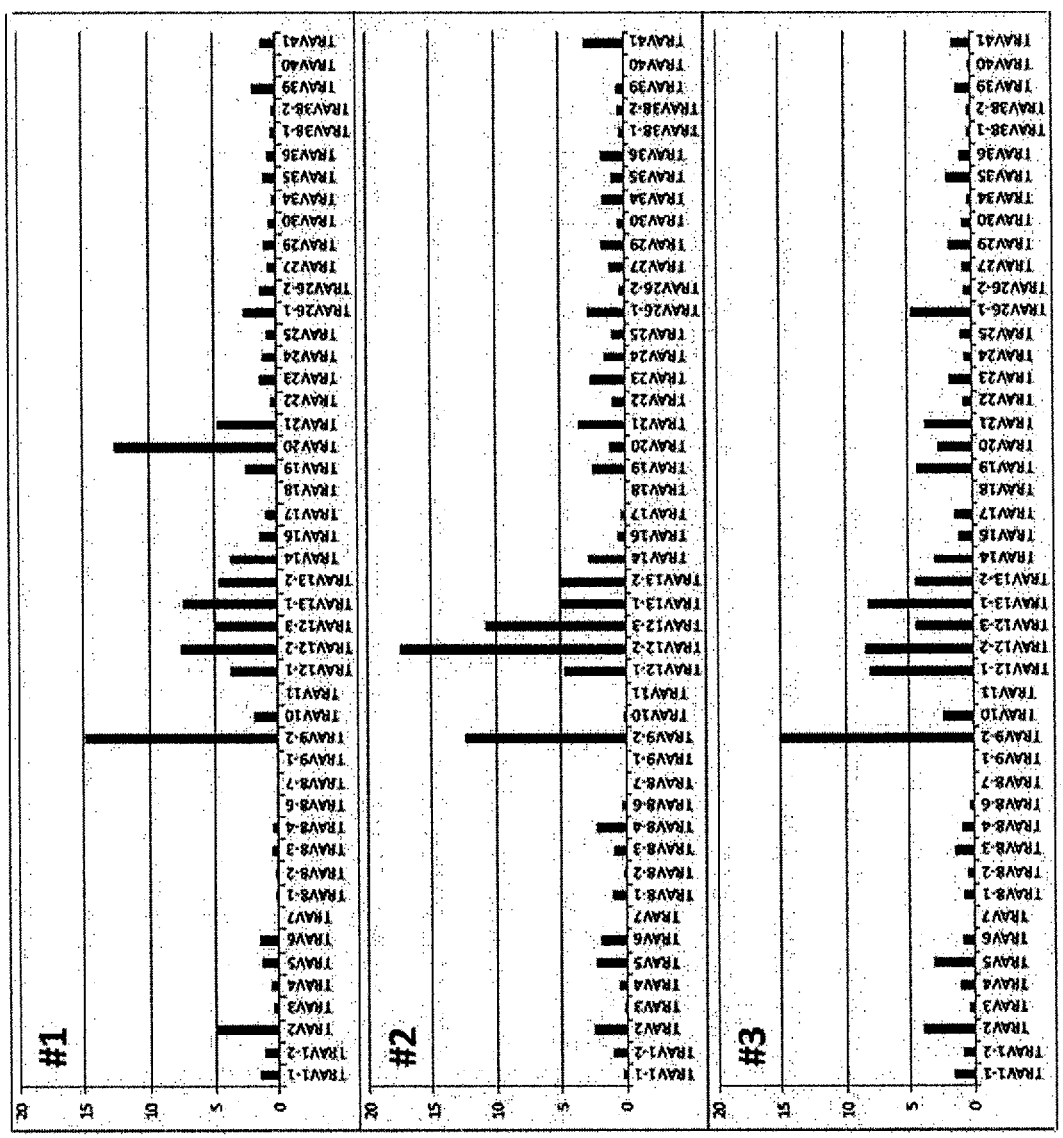
Fig. 13A ※ Horizontal axis indicates TRAV gene, vertical axis indicates frequency of presence thereof (%)

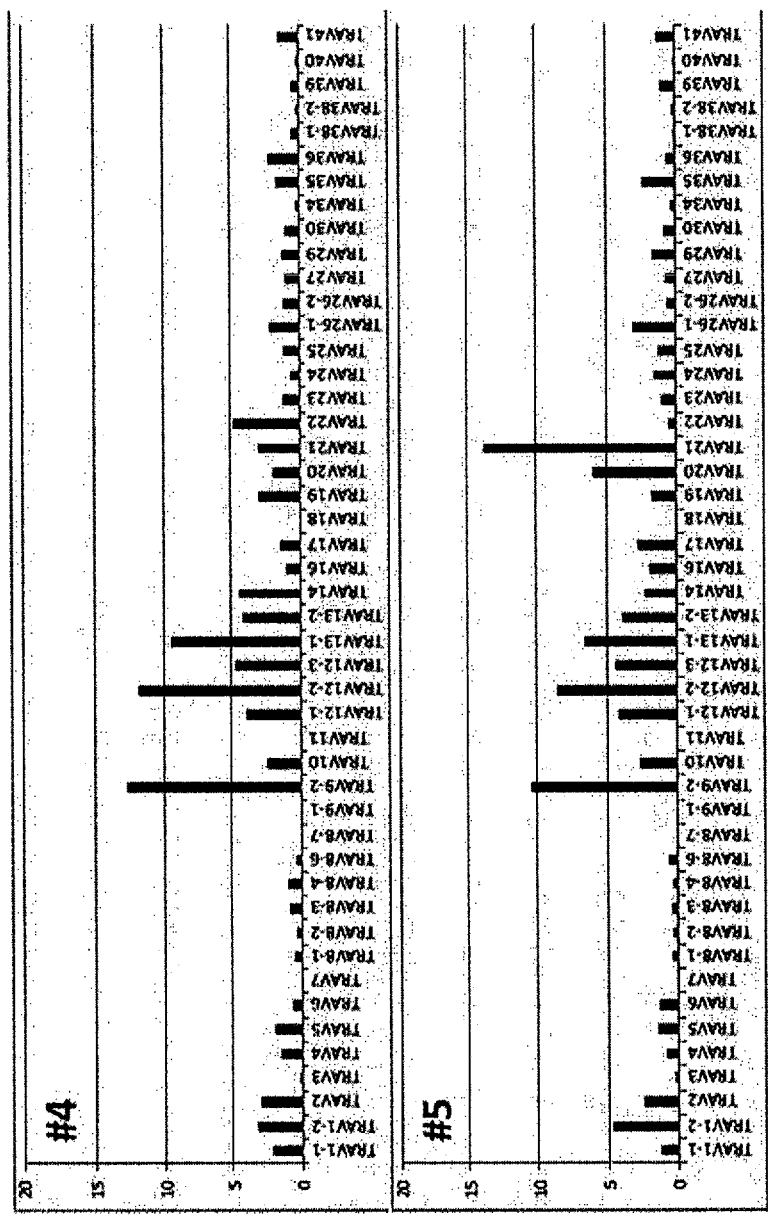
Fig. 13B ※ Horizontal axis indicates TRAV gene, vertical axis indicates frequency of presence thereof (%)

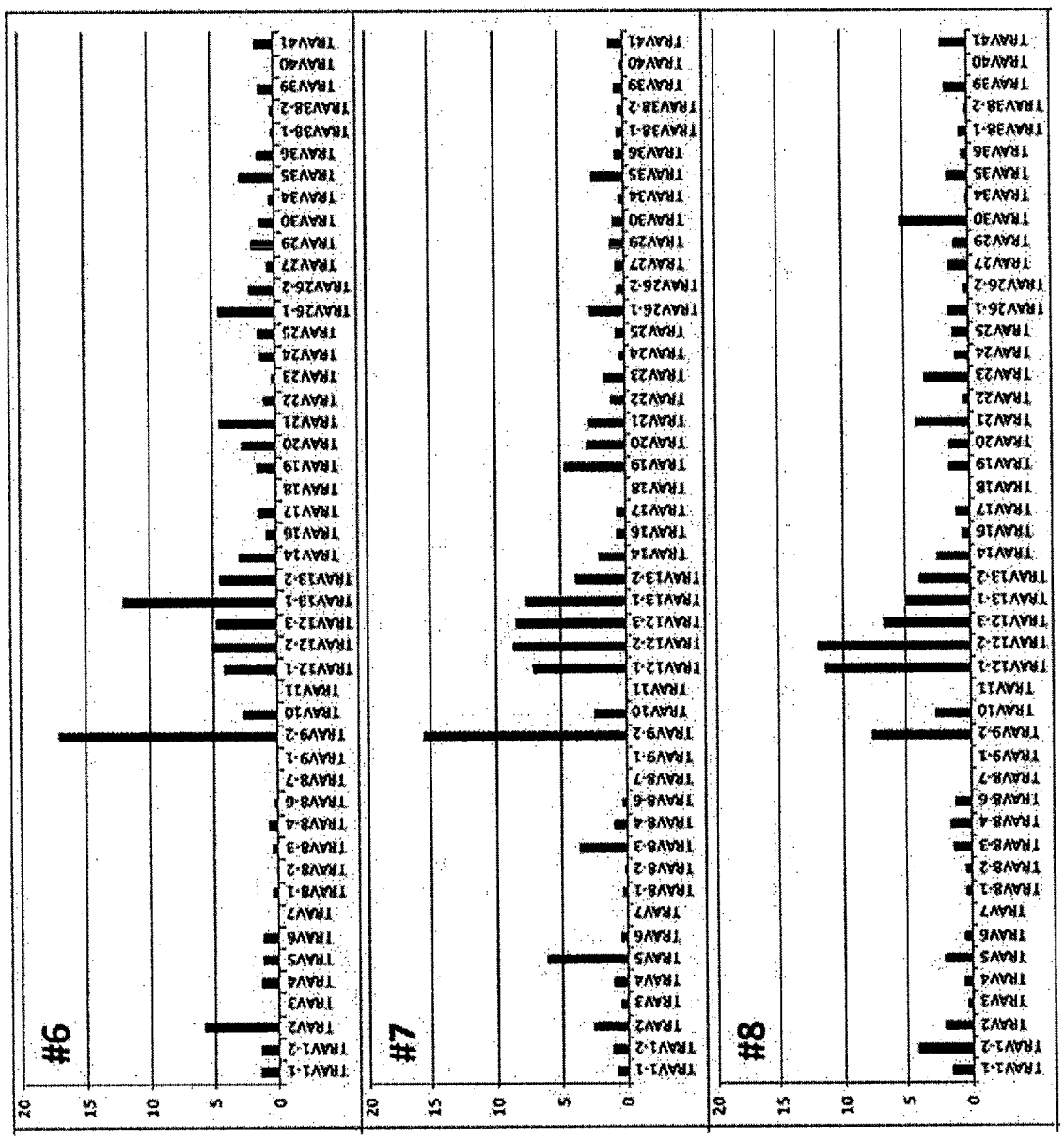
Fig. 13C  Horizontal axis indicates TRAV gene, vertical axis indicates frequency of presence thereof (%)

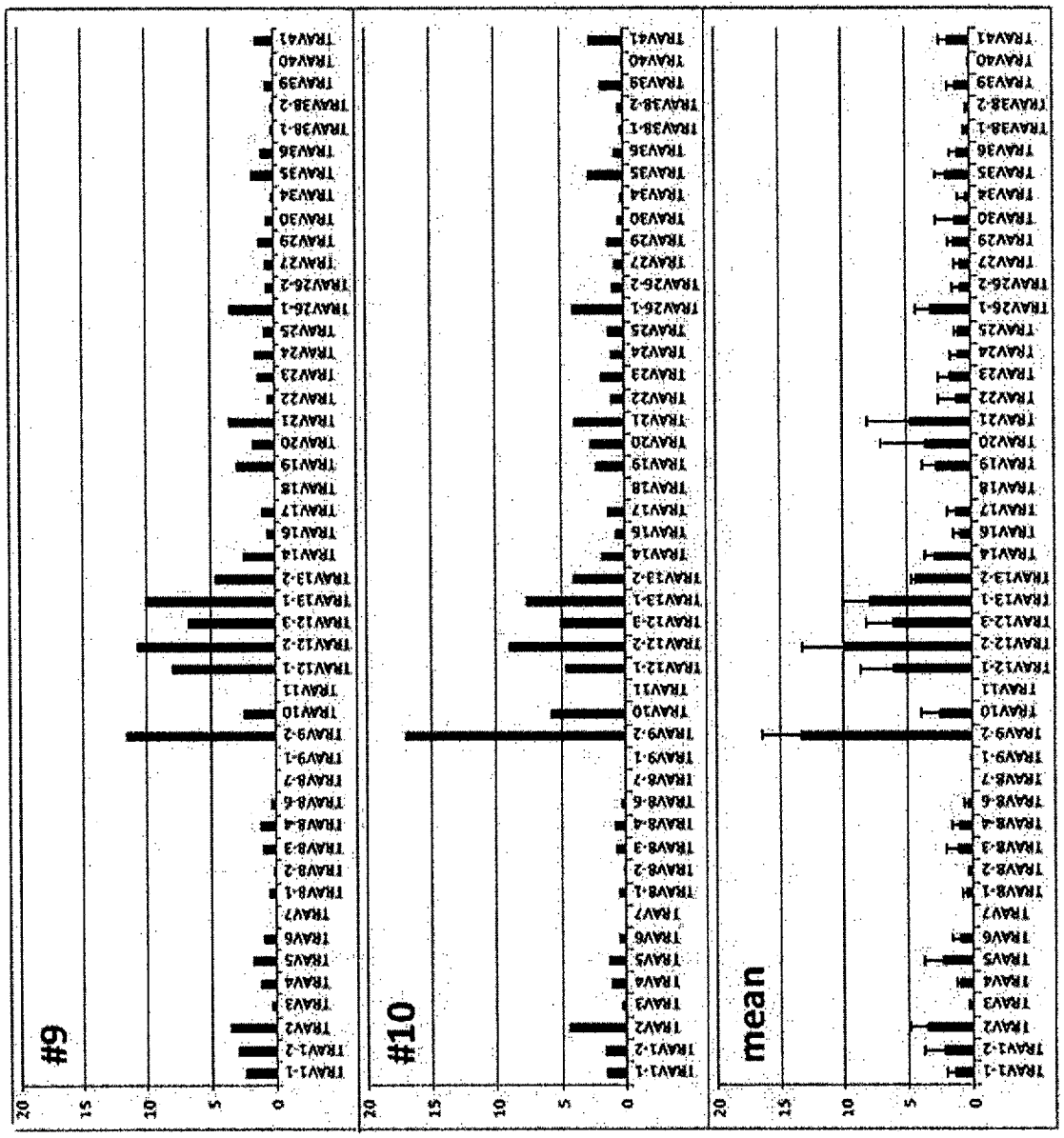
Fig. 13D ※Horizontal axis indicates TRAV gene, vertical axis indicates frequency of presence thereof (%)

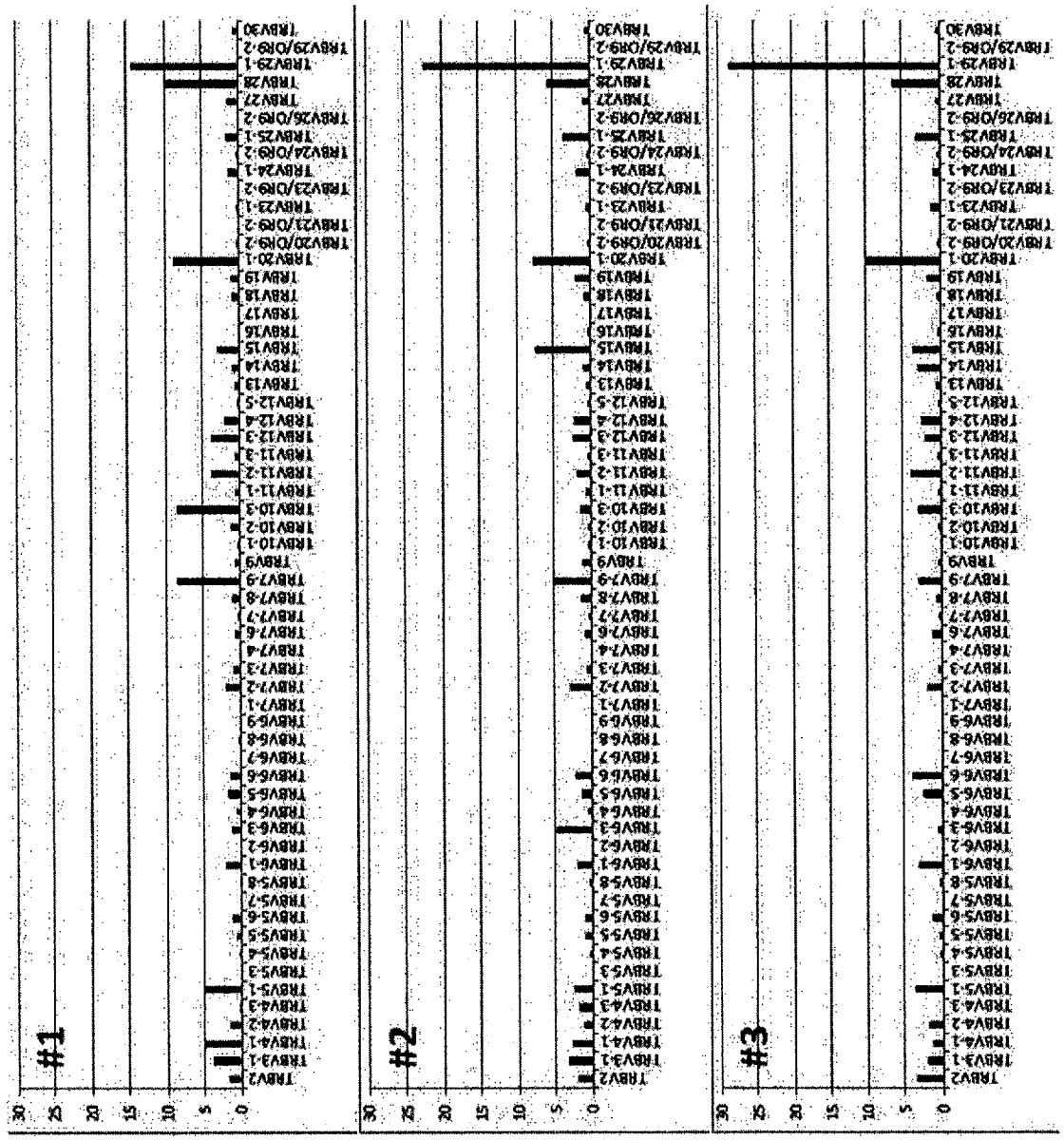
Fig. 14A  ※ Horizontal axis indicates TRBV gene, vertical axis indicates frequency of presence thereof (%)

※ Horizontal axis indicates TRBV gene, vertical axis indicates frequency of presence thereof (%)

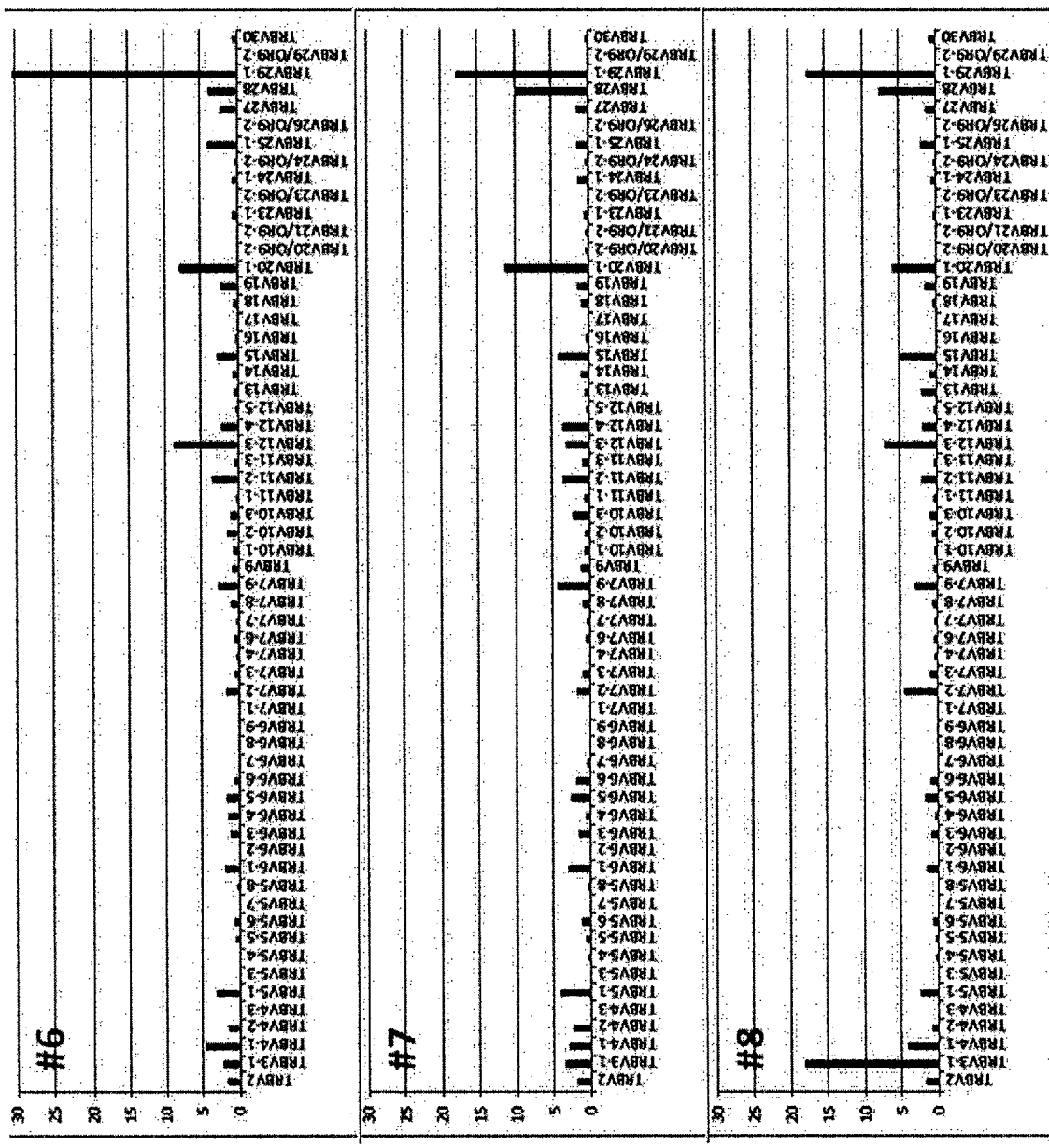
Fig. 14C  ※ Horizontal axis indicates TRBV gene, vertical axis indicates frequency of presence thereof (%)

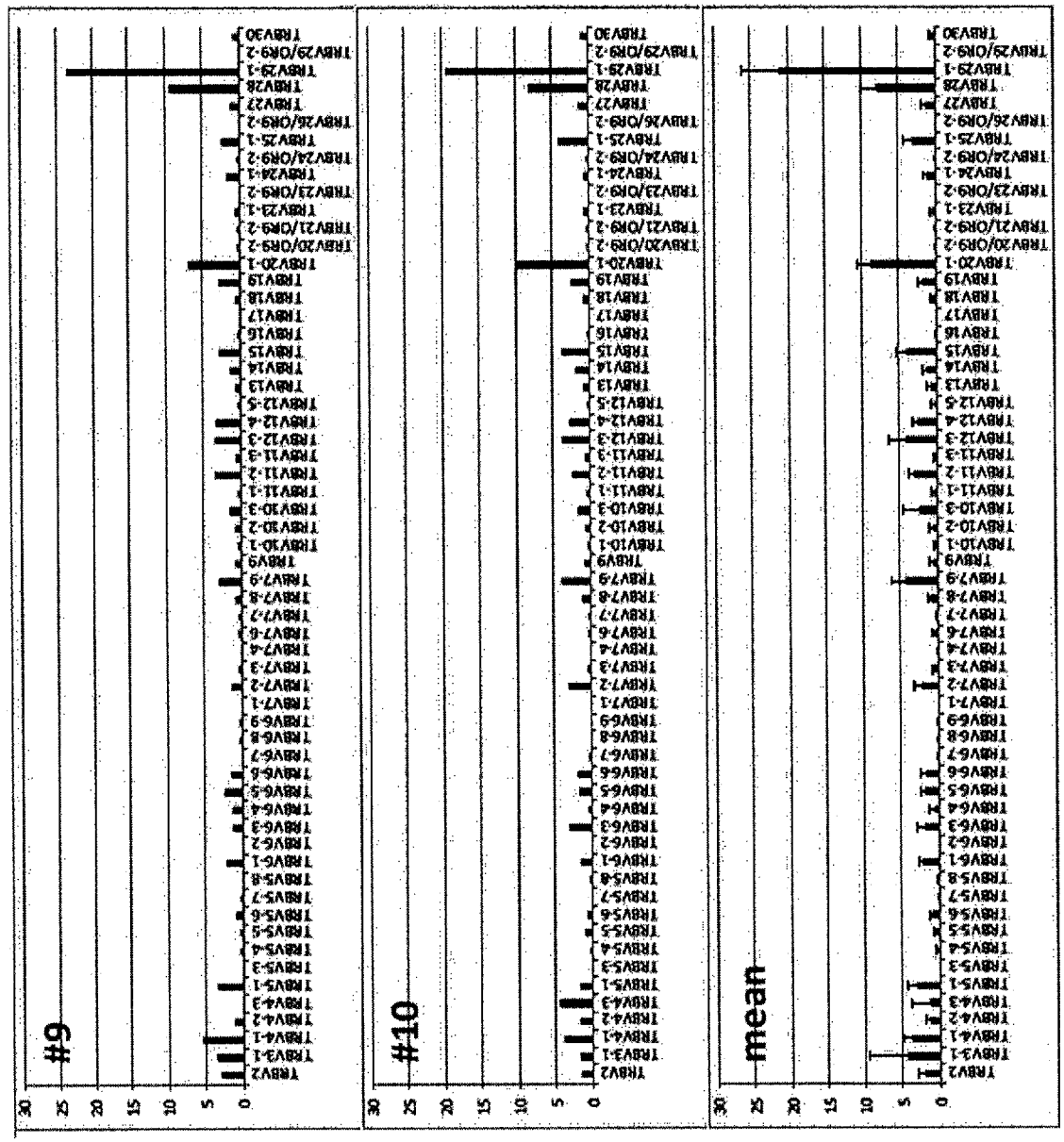
Fig. 14D  ※ Horizontal axis indicates TRBV gene, vertical axis indicates frequency of presence thereof (%)

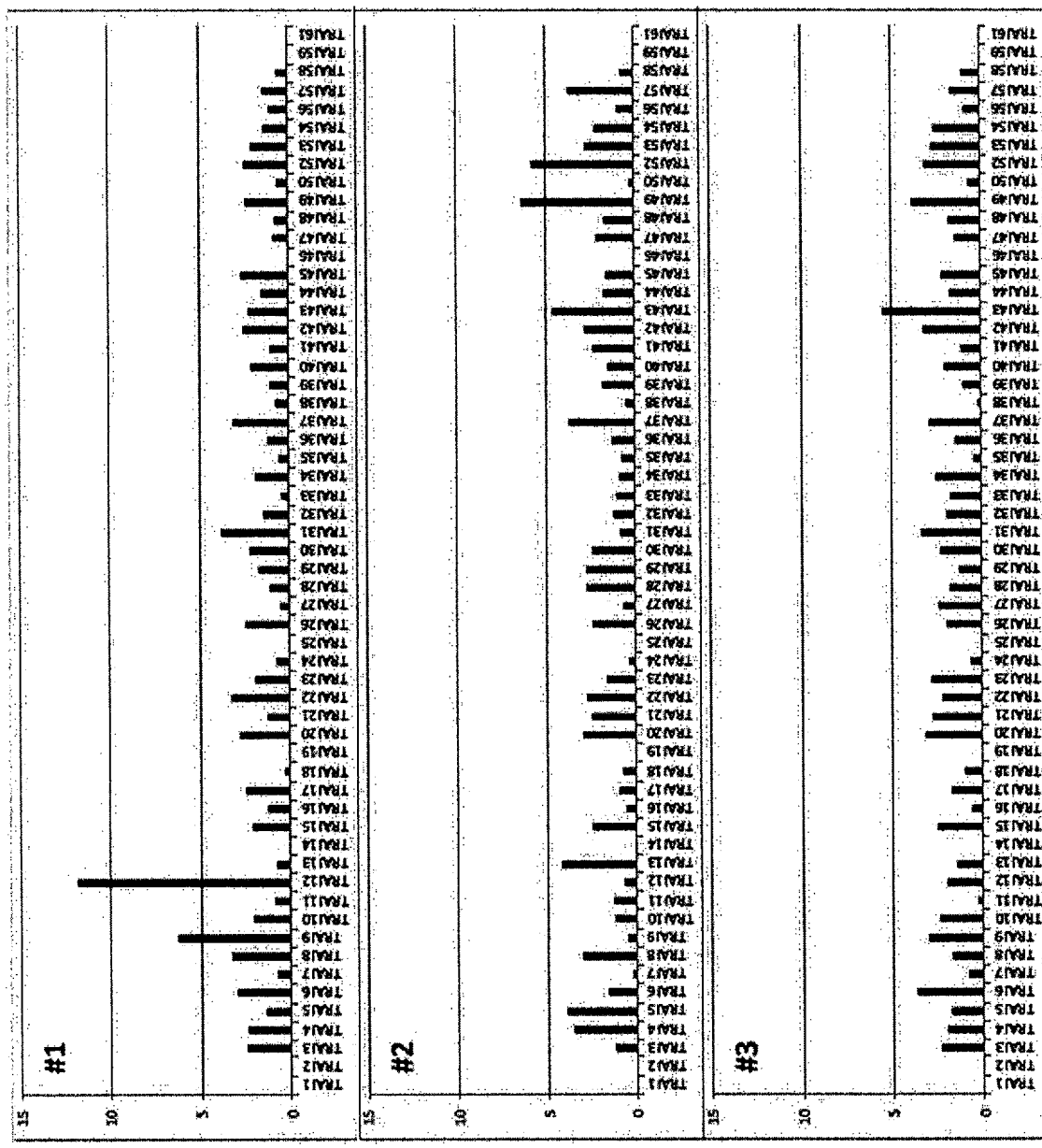
Fig. 15A ※Horizontal axis indicates TRAJ gene, vertical axis indicates frequency of presence thereof (%)

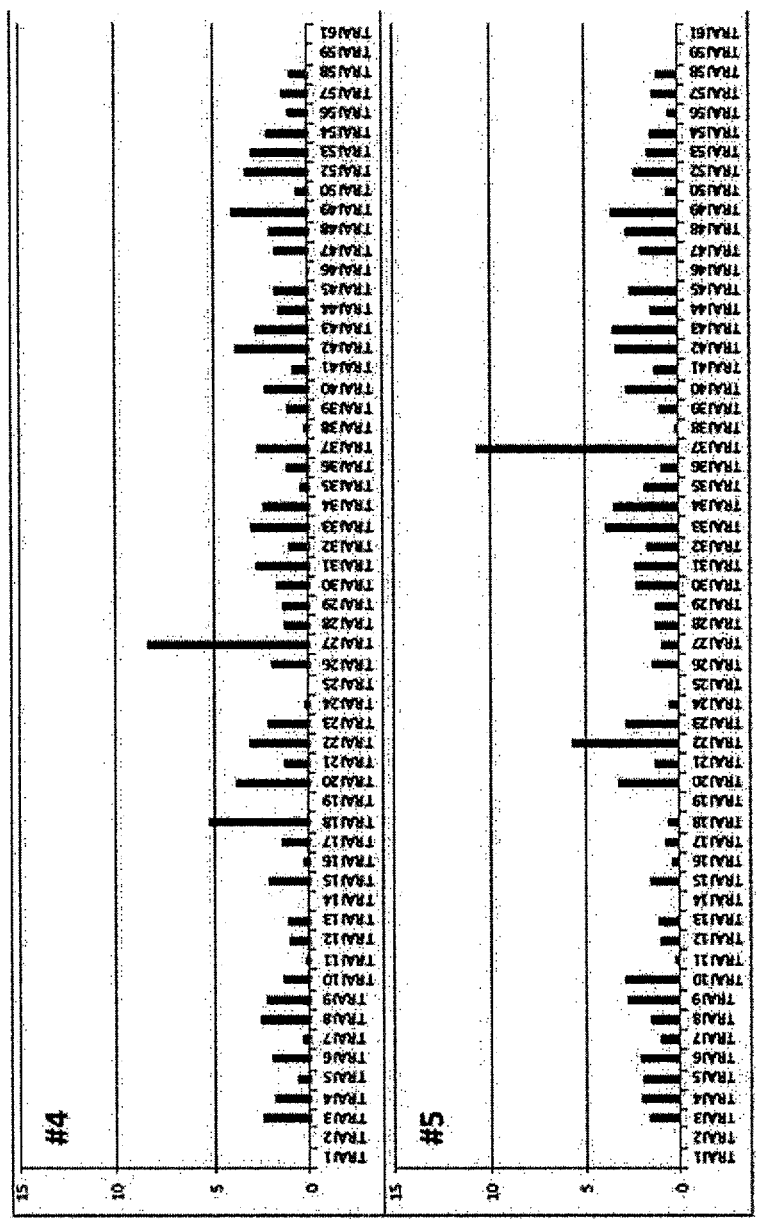
Fig. 15B ※ Horizontal axis indicates TRAJ gene, vertical axis indicates frequency of presence thereof (%)

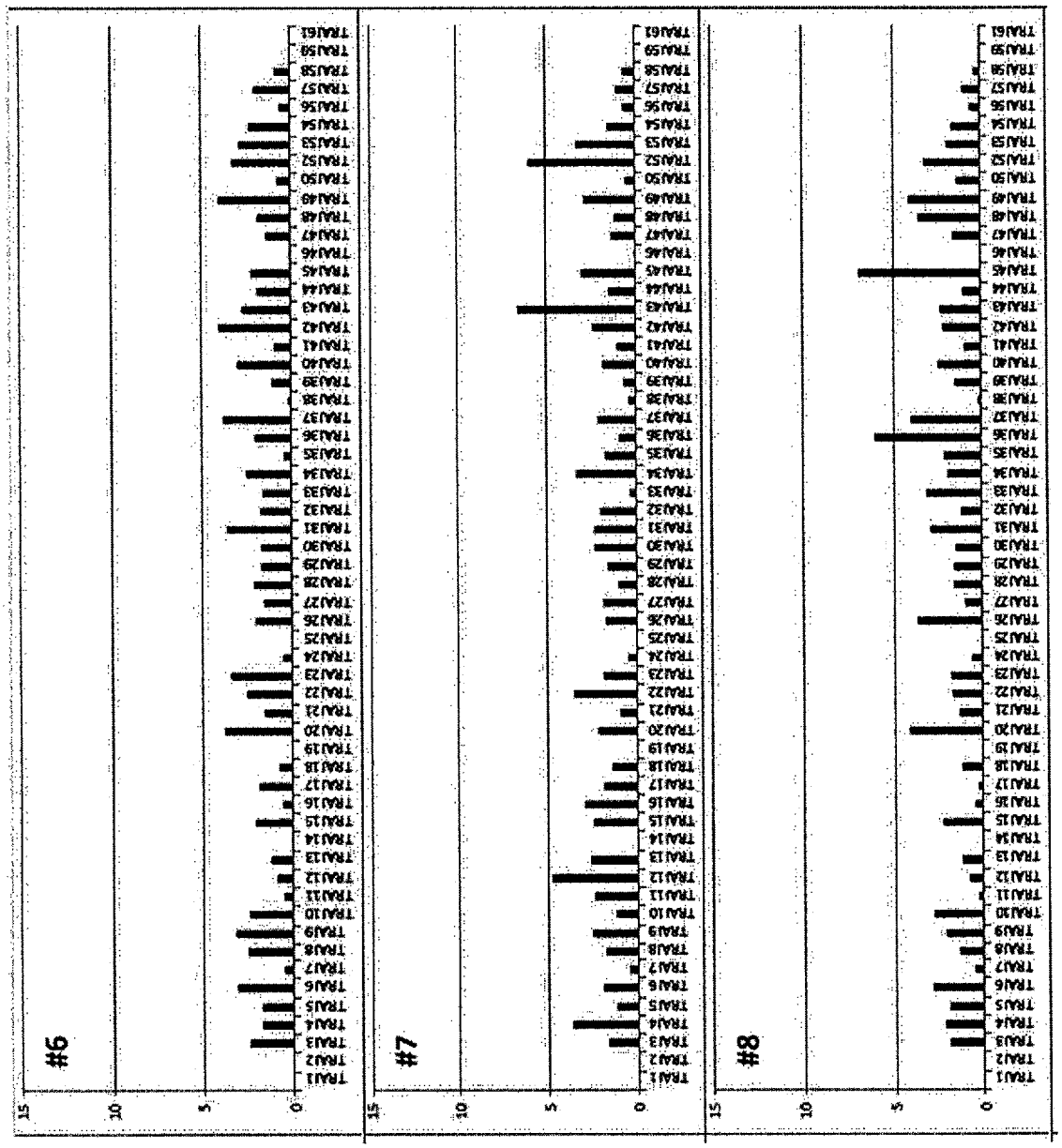
Fig. 15C  ※Horizontal axis indicates TRAJ gene, vertical axis indicates frequency of presence thereof (%)

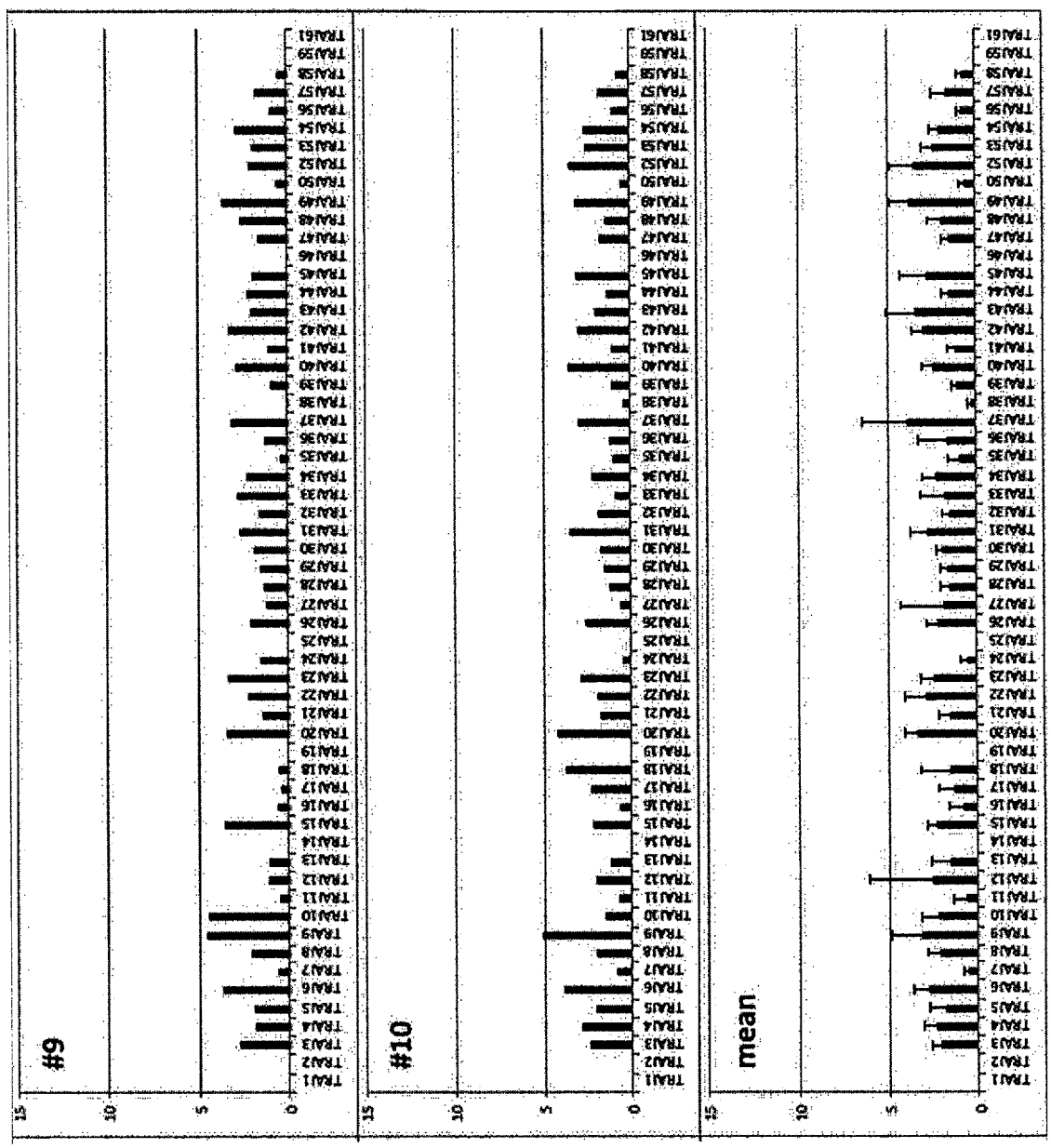
Fig. 15D ※Horizontal axis indicates TRAJ gene, vertical axis indicates frequency of presence thereof (%)

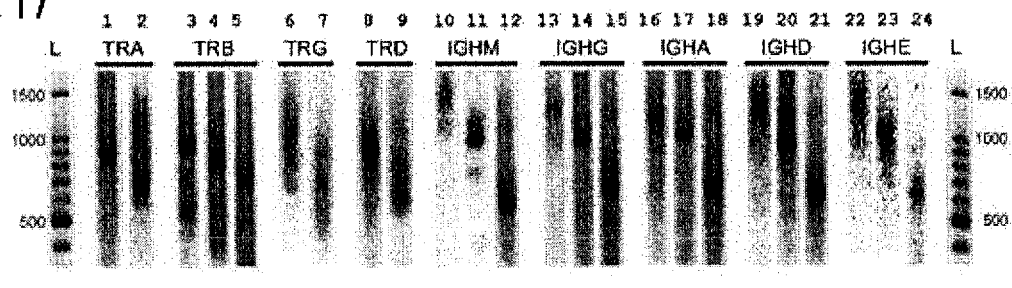

Fig. 17

L: DNA ladder
1: TRAC-3ter-1st, TRAC-3ter-2nd
2: CA1, CA2
3: TRBC-3ter-1st, TRBC-3ter-2nd
4: TRBC-Cent-1st, TRBC-Cent2nd
5: CB1, CB2
6: TRGC-3ter-1st, TRGC-3ter-2nd
7: CG1, CG2
8: TRDC-3ter-1st, TRDC-3ter-2nd
9: CD1, CD2
10: IGHM-3ter-1st, IGHM-3ter-2nd
11: IGHM-Cent-1st, IGHM-Cent-2nd
12: CM1, CM2
13: IGHG-3ter-1st, IGHG-3ter-2nd
14: IGHG-Cent-1st, IGHG-Cent-2nd
15: CG1, CG2 (for Ig)
16: IGHA-3ter-1st, IGHA-3ter-2nd
17: IGHA-Cent-1st, IGHA-Cent-2nd
18: CA1, CA2 (for Ig)
19: IGHD-3ter-1st, IGHD-3ter-2nd
20: IGHD-Cent-1st, IGHD-Cent-2nd
21: CD1, CD2 (for Ig)
19: IGHE-3ter-1st, IGHE-3ter-2nd
20: IGHE-Cent-1st, IGHE-Cent-2nd
21: CE1, CE2

| Ranking | TRBV | TRBJ | CDR3 | Reads |
|---|---|---|---|---|
| 1 | TRBV10-3 | TRBJ2-5 | CAISEPTGIRRDPVLR | 335 |
| 2 | TRBV20-1 | TRBJ2-1 | CSARESTSDPKNEQFFG | 301 |
| 3 | TRBV20-1 | TRBJ2-1 | CSARESTSDTKNEQFFG | 30 |
| 4 | TRBV20/OR9-2 | TRBJ2-1 | CSARESTSDTKNEQFFG | 14 |
| 5 | TRBV20-1 | TRBJ2-1 | CSARESTSDTKMSSSS | 6 |
| 6 | TRBV4-2 | TRBJ2-1 | CASSQTSGYQNEQFFG | 6 |
| 7 | TRBV10-3 | TRBJ2-5 | CAISEPTGIRRDPVLG | 5 |
| 8 | TRBV10-3 | TRBJ2-7 | CAIRGGSDSYEQYFG | 5 |
| 9 | TRBV19 | TRBJ1-5 | CASSRGQGDQPQHFG | 5 |
| 10 | TRBV9 | TRBJ2-1 | CASSEEQGWYNEQFFG | 5 |
| 11 | TRBV20/OR9-2 | TRBJ1-2 | CSARKDSGGYTFG | 4 |
| 12 | TRBV10-3 | TRBJ2-5 | CAISERQGSEETQYFG | 3 |
| 13 | TRBV12-4 | TRBJ1-5 | CASSLTGENQPQHFG | 3 |
| 14 | TRBV12-4 | TRBJ2-5 | CASSFDRLAGGETQYFG | 3 |
| 15 | TRBV20/OR9-2 | TRBJ2-1 | CSARESTSDTKMSSSS | 3 |
| 16 | TRBV3-1 | TRBJ2-3 | CASSRGGDTQYFG | 3 |
| 17 | TRBV5-6 | TRBJ1-1 | CASSLRDRDTEAFFG | 3 |
| 18 | TRBV6-1 | TRBJ2-5 | CASSEDWGPYQETQYFG | 3 |
| 19 | TRBV10-3 | TRBJ2-5 | CAISEPTGDQKRPSTS | 2 |
| 20 | TRBV10-3 | TRBJ2-5 | CAISEPTGIRRDPSTS | 2 |
| 21 | TRBV10-3 | TRBJ2-5 | CAISEPTGIRRDPVRS | 2 |
| 22 | TRBV18 | TRBJ1-4 | CASSPGQGEDEKLFFG | 2 |
| 23 | TRBV20-1 | TRBJ2-1 | CSARESTSDPKMSSLR | 2 |
| 24 | TRBV20-1 | TRBJ2-1 | CSARGSTSDPKMSSSS | 2 |
| 25 | TRBV20-1 | TRBJ2-5 | CSARESTSDPKMSSSS | 2 |
| 26 | TRBV20/OR9-2 | TRBJ2-1 | CSARESTSDTKNEXFFG | 2 |
| 27 | TRBV25-1 | TRBJ1-1 | CASTDTLNTEAFFG | 2 |
| 28 | TRBV28 | TRBJ2-3 | CASSSPGQGGSQRDTQYFG | 2 |
| 29 | TRBV7-9 | TRBJ2-1 | CASSLTGNEQFFG | 2 |
| 30 | TRBV10-2 | TRBJ1-5 | CASSDRDSNQPQHFG | 1 |
| 31 | TRBV10-3 | TRBJ2-1 | CAIRGGSDSYEQFFG | 1 |
| 32 | TRBV15 | TRBJ1-5 | CATSTPDRPPAPSIL | 1 |
| 33 | TRBV15 | TRBJ2-3 | CATSRDTLAEGPKIRSIL | 1 |
| 34 | TRBV18 | TRBJ1-1 | CASSPQGEEAFLD | 1 |
| 35 | TRBV18 | TRBJ2-7 | CASSPDAGGILRAVLR | 1 |
| 36 | TRBV28 | TRBJ1-2 | CASSLLRDRDGYTFG | 1 |
| 37 | TRBV28 | TRBJ1-2 | CASSLMVPVYGYTFG | 1 |
| 38 | TRBV9 | TRBJ2-7 | CASSAAGGPYEQYFG | 1 |
| 39 | TRBV29-1 | TRBJ2-6 | CSAVITKSGANVLTFG | 1 |
| 40 | TRBV3-1 | TRBJ2-5 | CASSQARQETQYFG | 1 |

Fig. 27B

| | Ranking | TRBV | TRBJ | CDR3 | Reads |
|---|---|---|---|---|---|
| 1% | 1 | TRBV20-1 | TRBJ2-1 | CSARESTSDPKNEQFFG | 293 |
| | 2 | TRBV10-3 | TRBJ2-5 | CAISEPTGIRRDPVLR | 223 |
| | 3 | TRBV20-1 | TRBJ1-5 | CSASRDENSNQPQHFG | 48 |
| | 4 | TRBV7-7 | TRBJ2-5 | CASSFLTSGSETQYFG | 41 |
| | 5 | TRBV28 | TRBJ2-7 | CASSPTGVGTSSYEQYFG | 27 |
| | 6 | TRBV20-1 | TRBJ2-1 | CSARESTSDTKNEQFFG | 24 |
| | 7 | TRBV15 | TRBJ1-2 | CATSRVSRQGYGYTFG | 23 |
| | 8 | TRBV7-3 | TRBJ2-1 | CASSPTGTRGEKQFFG | 23 |
| | 9 | TRBV20-1 | TRBJ1-5 | CSASRDEIAISPSIL | 20 |
| | 10 | TRBV6-5 | TRBJ1-2 | CASRTGDYGYTFG | 20 |
| | 11 | TRBV4-1 | TRBJ2-7 | CASSHTGGRVYEQYFG | 18 |
| | 12 | TRBV5-6 | TRBJ2-7 | CASSLVGDSYEQYFG | 18 |
| | 13 | TRBV6-3 | TRBJ2-7 | CASSYRLDSEGLYEQYFG | 18 |
| | 14 | TRBV7-2 | TRBJ2-7 | CASSIAGGPYEQYFG | 18 |
| | 15 | TRBV29-1 | TRBJ2-1 | CSVDGPYNEQFFG | 16 |
| | 16 | TRBV15 | TRBJ2-3 | CATSRDTLAGGPEDTQYFG | 14 |
| | 17 | TRBV7-9 | TRBJ2-3 | CASSLVAGGVDTQYFG | 13 |
| | 18 | TRBV28 | TRBJ2-5 | CASSLSGWETQYFG | 12 |
| | 19 | TRBV29-1 | TRBJ2-1 | CSVGHGWREIERSYNEQFFG | 12 |
| | 20 | TRBV5-6 | TRBJ2-7 | CASSLSSYEQYFG | 12 |
| | 21 | TRBV28 | TRBJ2-3 | CASSLTGGADTQYFG | 10 |
| | 22 | TRBV7-3 | TRBJ2-1 | CASSPPGREGRSSSS | 10 |
| | 23 | TRBV10-3 | TRBJ2-5 | CAISEPTGDQKRPSTS | 9 |
| | 24 | TRBV2 | TRBJ1-1 | CASSRAVEAFFG | 9 |
| | 25 | TRBV6-1 | TRBJ2-7 | CASSEDGLAEISYEQYFG | 9 |
| | 26 | TRBV29-1 | TRBJ2-7 | CSVGVSGGYEQYFG | 8 |
| | 27 | TRBV4-1 | TRBJ1-6 | CASSQDLRGWTGVNSPLHFG | 8 |
| | 28 | TRBV5-8 | TRBJ2-2 | CASSLDNRFGGTGELFLE | 8 |
| | 29 | TRBV7-4 | TRBJ2-7 | CASSSNRAGALPTSSTS | 8 |
| | 30 | TRBV12-4 | TRBJ1-5 | CASSPGGGQPQHFG | 7 |
| | 31 | TRBV7-2 | TRBJ2-7 | CASSSATGDLYEQYFG | 7 |
| | 32 | TRBV7-9 | TRBJ2-2 | CASSPTRNTGELFLE | 7 |
| | 33 | TRBV29-1 | TRBJ2-2 | CSARDSNTGELFLE | 6 |
| | 34 | TRBV7-9 | TRBJ2-2 | CASSPTRNTGELFFG | 6 |
| | 35 | TRBV12-4 | TRBJ2-6 | CASSRTGFGANVLTFG | 5 |
| | 36 | TRBV18 | TRBJ1-4 | CASSGGESLNENCFL | 5 |
| | 37 | TRBV20/OR9-2 | TRBJ2-1 | CSARESTSDTKNEQFFG | 5 |
| | 38 | TRBV20/OR9-2 | TRBJ2-1 | CSARESTSESKNEQFFG | 5 |
| | 39 | TRBV27 | TRBJ2-1 | CASSRAGRGLNEQFFG | 5 |
| | 40 | TRBV7-2 | TRBJ2-5 | CASSVINGGETQYFG | 5 |

Fig. 27C

| | 0.10% | | | |
|---|---|---|---|---|
| Ranking | TRBV | TRBJ | CDR3 | Reads |
| 1 | TRBV29-1 | TRBJ2-3 | CSVSSTDTQYFG | 141 |
| 2 | TRBV19 | TRBJ2-5 | CASSWGLAVGYQETQYFG | 121 |
| 3 | TRBV4-2 | TRBJ2-1 | CASSQDQILPYNEQFFG | 99 |
| 4 | TRBV19 | TRBJ2-1 | CASGHTGSAYNEQFFG | 66 |
| 5 | TRBV20-1 | TRBJ2-1 | CSARESTSDPKNEQFFG | 61 |
| 6 | TRBV29-1 | TRBJ2-5 | CSVEAKEGLRTQYFG | 51 |
| 7 | TRBV7-3 | TRBJ1-6 | CASSLNRGSPLHFG | 37 |
| 8 | TRBV4-1 | TRBJ2-5 | CASSKPGLAVQETQYFG | 35 |
| 9 | TRBV20-1 | TRBJ2-5 | CSARTAGLGTQYFG | 31 |
| 10 | TRBV27 | TRBJ1-2 | CASRPTALGGYTFG | 31 |
| 11 | TRBV5-7 | TRBJ1-5 | CAPRNHQIAISPSIL | 31 |
| 12 | TRBV7-9 | TRBJ2-1 | CASSLGGRASYNEQFFG | 30 |
| 13 | TRBV11-1 | TRBJ2-1 | CASSLMLAPLYNEQFFG | 28 |
| 14 | TRBV15 | TRBJ2-3 | CATSRDTLAGGPEDTQYFG | 27 |
| 15 | TRBV11-1 | TRBJ2-5 | CASSRDRGRQETQYFG | 25 |
| 16 | TRBV20-1 | TRBJ2-1 | CSAPPGLAINEQFFG | 21 |
| 17 | TRBV20-1 | TRBJ2-1 | CSARGWAGPYNEQFFG | 21 |
| 18 | TRBV12-4 | TRBJ2-5 | CASSFGTPKRPSTS | 20 |
| 19 | TRBV11-2 | TRBJ2-1 | CASSLVGLYNEQFFG | 19 |
| 20 | TRBV20-1 | TRBJ2-3 | CSATGDSKINTQYFG | 19 |
| 21 | TRBV5-6 | TRBJ2-1 | CASRSLWSSYNEQFFG | 19 |
| 22 | TRBV5-6 | TRBJ1-1 | CASNPTEENTEAFFG | 18 |
| 23 | TRBV12-4 | TRBJ2-5 | CASSFGTPQETQYFG | 17 |
| 24 | TRBV7-9 | TRBJ2-1 | CASSQSRRAHNEQFFG | 17 |
| 25 | TRBV15 | TRBJ2-1 | CATSREGLAGENEQFFG | 16 |
| 26 | TRBV12-5 | TRBJ1-4 | CASGLESLGHLNENCFW | 15 |
| 27 | TRBV19 | TRBJ1-5 | CASSIRDRSNQPQHFG | 15 |
| 28 | TRBV20-1 | TRBJ1-3 | CSARRFGDGGDTIYFG | 15 |
| 29 | TRBV5-6 | TRBJ2-2 | CASSLSVGGELFFG | 15 |
| 30 | TRBV6-3 | TRBJ2-3 | CASSLAGVADTQYFG | 15 |
| 31 | TRBV7-9 | TRBJ2-2 | CASSPGQYTGELFFG | 14 |
| 32 | TRBV11-3 | TRBJ2-5 | CASSSTPTSQSRRPSTS | 12 |
| 33 | TRBV19 | TRBJ1-1 | CASSQRRATEAFFG | 12 |
| 34 | TRBV27 | TRBJ2-7 | CASTPQVGGINEQYFG | 12 |
| 35 | TRBV6-1 | TRBJ2-3 | CASHRAPDTQYFG | 12 |
| 36 | TRBV6-1 | TRBJ2-7 | CASTGRRQLTYEQYFG | 12 |
| 37 | TRBV10-3 | TRBJ2-5 | CAISPGQEETQYFG | 10 |
| 38 | TRBV11-2 | TRBJ1-2 | CASSLGRYYGYTFG | 10 |
| 39 | TRBV30 | TRBJ2-2 | CAWSSGGELFLE | 10 |
| 40 | TRBV5-4 | TRBJ1-1 | CASSLGQAKEAFFG | 10 |

Fig. 27D 0.01%

| Ranking | TRBV | TRBJ | CDR3 | Reads |
|---|---|---|---|---|
| 365 | TRBV10-1 | TRBJ2-1 | AASSEQLSSYNEQFFG | 1 |
| 366 | TRBV10-1 | TRBJ2-1 | CASSEQLSSYNEQFFR | 1 |
| 367 | TRBV10-1 | TRBJ2-1 | CASSTGQDRVMSSSS | 1 |
| 368 | TRBV10-1 | TRBJ2-1 | CASSTRGQDRVMSSSS | 1 |
| 369 | TRBV10-2 | TRBJ1-5 | CAQILGGDRGAGGKSAPSIF | 1 |
| 370 | TRBV10-2 | TRBJ1-5 | CAQILGGDRGLGESAPAFW | 1 |
| 371 | TRBV10-2 | TRBJ1-5 | CAQILGGDRGLGGISPSIL | 1 |
| 372 | TRBV10-2 | TRBJ1-5 | CARFSEGQGAGGISPSIL | 1 |
| 373 | TRBV10-2 | TRBJ1-5 | CARFSEGRGAGGISPSIL | 1 |
| 374 | TRBV10-2 | TRBJ1-5 | CARFSEGRGGWGNQPQHFG | 1 |
| 375 | TRBV10-2 | TRBJ1-5 | CARFSEGTGGSGESAPAFW | 1 |
| 376 | TRBV10-2 | TRBJ1-5 | CARFSEGTGGWGDQPQHFX | 1 |
| 377 | TRBV10-2 | TRBJ1-5 | CARFSEGTGGWGESAPSIF | 1 |
| 378 | TRBV10-2 | TRBJ1-5 | CARFSEGTGGWGNQPPAFL | 1 |
| 379 | TRBV10-2 | TRBJ1-5 | CASFSEGQGLGESAPAFW | 1 |
| 380 | TRBV10-2 | TRBJ1-5 | RARFSEGTGGWGNQPQHFG | 1 |
| 381 | TRBV10-2 | TRBJ1-5 | XAQILGGDRGAGGNQPQHFG | 1 |
| 382 | TRBV10-2 | TRBJ1-5 | XARFSEGTGGLGGISPSIL | 1 |
| 383 | TRBV10-3 | TRBJ1-3 | CAISPNRGGLETPYIL | 1 |
| 384 | TRBV10-3 | TRBJ1-3 | CAISPNRGGSGNTIYFG | 1 |
| 385 | TRBV10-3 | TRBJ2-3 | CAIRPSGPHRYAVFL | 1 |
| 386 | TRBV10-3 | TRBJ2-3 | CAIRPSGPTDTQXLA | 1 |
| 387 | TRBV10-3 | TRBJ2-3 | CAISIEAVQIRSIL | 1 |
| 388 | TRBV10-3 | TRBJ2-3 | CAISIEAXTXTQYFA | 1 |
| 389 | TRBV10-3 | TRBJ2-3 | CAISSTTDTQYFW | 1 |
| 390 | TRBV10-3 | TRBJ2-5 | CAISEPTGIRRDPVLR | 1 |
| 391 | TRBV10-3 | TRBJ2-7 | CAISESASGSYEQYFG | 1 |
| 392 | TRBV11-1 | TRBJ2-1 | CASRLYTEQFFG | 1 |
| 393 | TRBV11-1 | TRBJ2-1 | CASSFGGLLSSSS | 1 |
| 394 | TRBV11-1 | TRBJ2-1 | CASSFPGGLLSSSS | 1 |
| 395 | TRBV11-1 | TRBJ2-1 | CASSFTMSSSS | 1 |
| 396 | TRBV11-1 | TRBJ2-1 | CASSVFTMSSSS | 1 |
| 397 | TRBV11-1 | TRBJ2-1 | CAXSFYNEQFFG | 1 |
| 398 | TRBV11-1 | TRBJ2-1 | VPSSFYNEQFFR | 1 |
| 399 | TRBV11-1 | TRBJ2-3 | CASSFRSCRYAVFW | 1 |
| 400 | TRBV11-1 | TRBJ2-3 | CASSLDRADTQYFG | 1 |
| 401 | TRBV11-1 | TRBJ2-3 | CASTLRFRIRSIL | 1 |
| 402 | TRBV11-1 | TRBJ2-5 | CASSFRPGTETPVLR | 1 |
| 403 | TRBV11-1 | TRBJ2-5 | CASSSETQYFG | 1 |
| 404 | TRBV11-2 | TRBJ1-1 | CASSLQGANTEAFFG | 1 |

Fig. 29 Data analysis process (TCR)
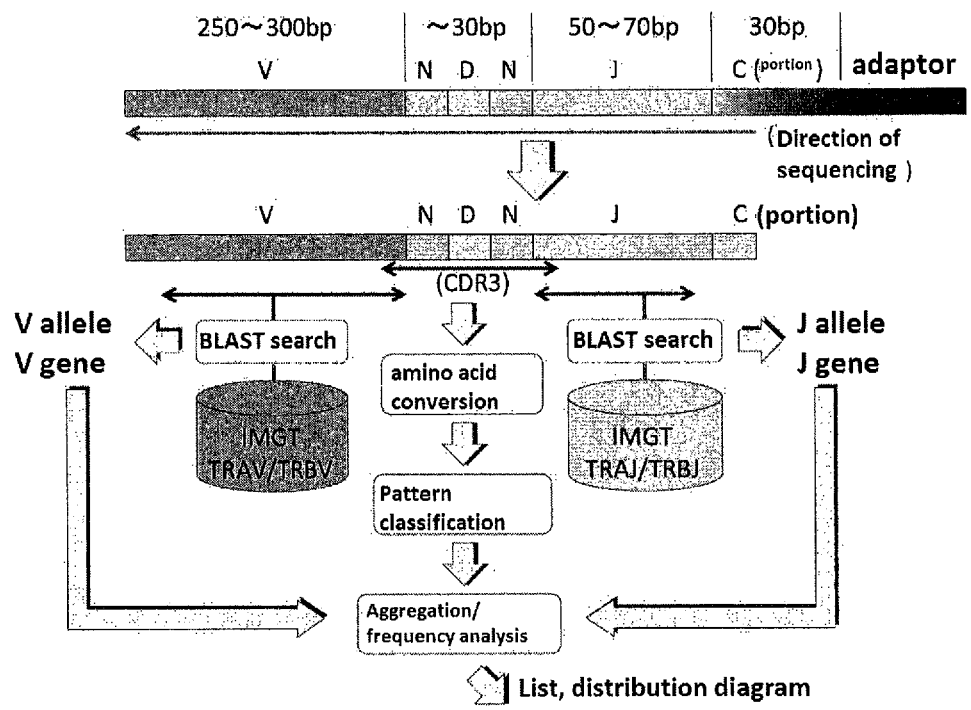
Fig. 30 Data analysis process (BCR)
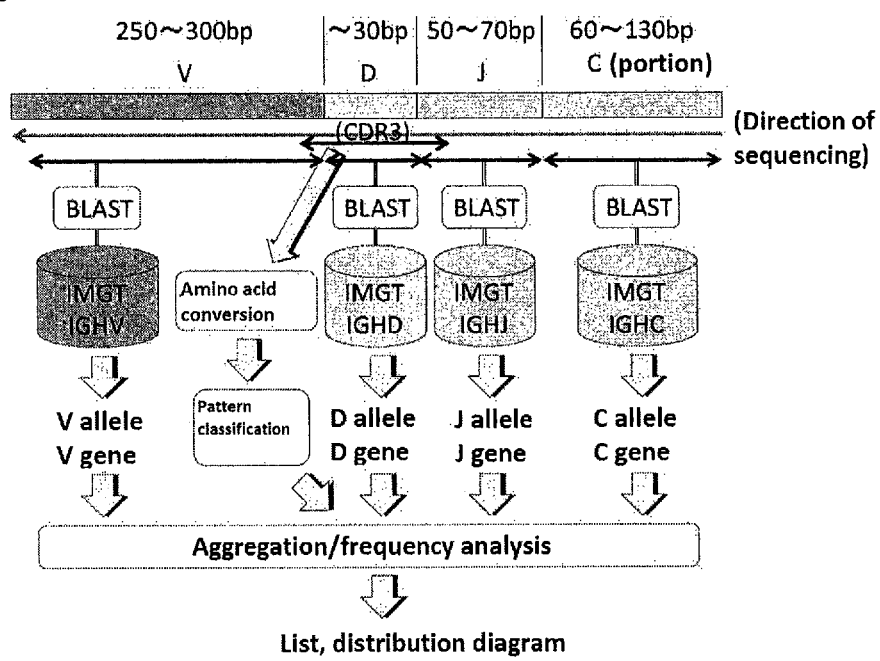

3D plot of TRA repertoire 3D plot of TRB repertoire

T CELL RECEPTOR AND B CELL RECEPTOR REPERTOIRE ANALYSIS SYSTEM, AND USE OF SAME IN TREATMENT AND DIAGNOSIS

TECHNICAL FIELD

The present invention relates to a technology of amplifying a gene created by gene rearrangement from a biological sample without applying a bias, a system for analyzing the resulting genetic information, and therapy and diagnosis thereof.

STATEMENT REGARDING SEQUENCE LISTING

The Sequence Listing associated with this application is provided in text format in lieu of a paper copy, and is hereby incorporated by reference into the specification. The name of the text file containing the Sequence Listing is 790132_401USPC_SEQUENCE_LSTING.txt. The text file is 598 KB, was created on May 18, 2016, and is being submitted electronically via EFS-Web.

BACKGROUND ART

A biological defense mechanism utilizing an immune system is heavily dependent on specific immunity provided mainly by T cells and B cells. T cells and B cells do not react to their own cells or molecules and are capable of specifically recognizing and attacking exogenous pathogens such as viruses or bacteria. For this reason, T cells and B cells have a mechanism capable of recognizing and distinguishing autoantigens as well as various antigens derived from other organisms by a receptor molecule expressed on a cell surface. T cell receptor (TCR) and B cell receptor (BCR) act as an antigen receptor in T cells and B cells, respectively. An intracellular signal is transmitted by a stimulation from such antigen receptors. Production of inflammatory cytokines, chemokines or the like are enhanced, cell proliferation increased, and various immune responses are initiated. TCRs recognize a peptide bound to a peptide binding groove of a major histocompatibility complex (MHC) expressed on an antigen-presenting cell (peptide-MHC complex, pMHC) to distinguish self from non-self and recognize an antigen peptide (Non Patent Literature 1). TCRs are heterodimer receptor molecules consisting of two TCR polypeptide chains. There are $\alpha\beta$ TCRs expressed by normal T cells and $\gamma\delta$ TCRs with a special function. $\alpha$ and $\beta$ chain TCR molecules form a complex with a plurality of CD3 molecules (CD3$\zeta$ chain, CD3$\varepsilon$ chain, CD3$\gamma$ chain, and CD3$\delta$ chain), transmit an intracellular signal after antigen recognition, and initiate various immune responses. With a viral infection, an endogenous antigen such as a cancer antigen derived from a cancer cell or a viral antigen proliferated in a cell is presented as an antigen peptide on an MHC class I molecule. Further, an antigen derived from an exogenous microorganism is taken up and processed by an antigen-presenting cell by endocytosis, and then presented on an MHC class II molecule. Such antigens are recognized by TCRs expressed by each of CD8$^+$ T cell and CD4$^+$ T cell. It is also known that a costimulatory molecule such as a CD28, ICOS, or OX40 molecule is important for stimulation via a TCR molecule.

A TCR gene consists of numerous V regions (variable region, V), J regions (joining region, J), D regions (diversity region, D), and constant regions, C regions (C) encoded by different regions in the genome. In T cell differentiation process, such gene fragments are genetically rearranged in various combinations. $\alpha$ chain and $\gamma$ chain TCRs express genes consisting of V-J-C and $\beta$ chain and $\delta$ chain TCRs express genes consisting of V-D-J-C. Currently, database of the IMGT (the International ImMuno GeneTics project) has 43 types of functional $\alpha$ chain TCR V gene fragments (TRAV), 50 types of TCR J gene fragments (TRAJ), 40-42 types of functional $\beta$ chain TCR V gene fragments (TRBV), 2 types of TCR D gene fragments (TRBD), types of TCR J gene fragments (TRBJ), 4-6 types of functional $\gamma$ chain V gene fragments (TRGV), 5 types of TCR J gene fragments (TRGJ), 3 types of functional $\delta$ chain V gene fragments (TRDV), 3 types of TCR D gene fragments (TRDD), and 4 types of TCR J gene fragments (TRDJ) (Non Patent Literature 2). Diversity is created by rearrangement of such gene fragments. In addition, insertion or deletion of one or more bases between V and D or D and J gene fragments leads to the formation of a random amino acid sequence to create a more diverse TCR gene sequence.

A region where a TCR molecule directly binds to a pMHC complex surface (TCR footprint) is composed of three diverse complementarity determining regions (CDR) within the V region, CDR1, CDR2, and CDR3 regions. The CDR3 region in particular comprises a part of a V region, a part of J region and a V-D-J region formed by a random sequence, forming the most diverse antigen recognition site. Meanwhile, the other regions are called FRs (framework region) serving the role of forming a backbone structure of a TCR molecule. In a differentiation and maturation process of a T cell in the thymus gland, a $\beta$ chain TCR is genetically rearranged initially, and conjugates with a pT$\alpha$ molecule to form a pre-TCR complex molecule. An $\alpha$ chain TCR is then rearranged to form an $\alpha\beta$ TCR molecule, and when a functional $\alpha\beta$ TCR is not formed, rearrangement occurs in the other $\alpha$ chain TCR gene allele. It is known that after undergoing positive/negative selection in the thymus gland, a TCR with a suitable affinity is selected to acquire antigen specificity (Non Patent Literature 3).

A BCR is known as an immunoglobulin (Ig). A membrane-bound Ig acts as an antigen receptor molecule as a BCR. A secretory protein thereof is secreted to the outside of a cell as an antibody. A large amount of antibodies is secreted from a terminally differentiated plasma cell and has functions to eliminate pathogens by binding to a pathogenic molecule such as a virus or bacteria or by a subsequent immune reaction such as a complement binding reaction. A BCR is expressed on a B cell surface. After binding to an antigen, the BCR transmits an intracellular signal to initiate various immune responses or cell proliferation. Diversity of amino acid sequences at an antigen-binding site is responsible for the specificity of a BCR. Sequences at an antigen-binding site greatly vary among BCR molecules and are called variable sections (V regions). Meanwhile, a sequence of a constant region (C region) is highly conserved among BCR molecules or antibody molecules. Such a region has an effector function of an antibody or a signaling function of a receptor.

A BCR and an antibody are the same except for the presence or absence of a membrane-binding domain. An Ig molecule consists of polypeptide chains, two heavy chains (H chains) and two light chains (L chains). In one Ig molecule, two H chains, or one H chain and one L chain, are bound by a disulfide bond. There are 5 different H chain classes (isotypes) called $\mu$ chain, $\alpha$ chain, $\gamma$ chain, $\delta$ chain, and $\varepsilon$ chain in Ig, which are called IgM, IgA, IgG, IgD, and IgE, respectively. It is known that functions and roles generally vary depending on the isotype, e.g., an antibody with a high level of specificity which is functional in biological defense is an IgG antibody, an IgA antibody is involved in mucosal immunity, and an IgE antibody is important in allergy, asthma, and atopic dermatitis. Furthermore, it is known that there are several types of subclasses in isotypes, such as IgG1, IgG2, IgG3, and IgG4. It is understood that there are two types of L chains, λ chain (IgL) and κ chain (IgK), which can bind to an H chain of any class, and there is no functional difference therebetween (Non Patent Literature 4).

As in TCR genes, BCR genes are formed by gene rearrangement that occurs in a somatic cell. A variable section is encoded in a few separate gene fragments in the genome, which induce somatic cell genetic recombination in the differentiation process of a cell. A genetic sequence of a variable section of an H chain consists of a C region (constant region, C) defining an isotype that is different from a D region, a J region, and a V region. Each gene fragment is separated in the genome, but is expressed as a series of V-D-J-C genes by gene rearrangement. The database of the IMGT has 38-44 types of functional IgH chain V gene fragments (IGHV), 23 types of D gene fragments (IGHD), 6 types of J gene fragments (IGHJ), 34 types of functional IgK chain V gene fragments (IGKV), 5 types of J gene fragments (IGKJ), 29-30 types of functional IgL chain V gene fragments (IGLV), and 5 types of J gene fragments (IGLJ). These gene fragments undergo gene rearrangement to ensure diversity of BCRs. Furthermore, highly diverse CDR3 regions are formed by a random insertion or deletion in an amino acid sequence as in TCRs (Non Patent Literature 2).

In a differentiation and maturation process of a B cell, IgM is initially produced by an immature B cell. A naive B cell that has not been exposed to an antigen coexpresses IgM and IgD. After being stimulated and activated by a stimulation of an antigen, a class switch (isotype switch) that converts a C region of IgM, Cμ, with a C region sequence of IgG, Cγ, occurs while the sequence of a variable section remains the same. Similarly, Cμ is converted to C region of IgA (Cα) or C region of IgE (Cε) to produce IgA or IgG. With such a class switch recombination, the type of antibody required for eliminating a pathogen is produced where it is required. Furthermore, in the proliferation process of a B cell that has undergone a class switch, a mutation occurs at a high frequency in the variable section of an IgG, IgA or IgE region (somatic hypermutation). As a result, a B cell that has acquired a higher level of specificity to an antigen is further stimulated and proliferated, such that an antibody producing B cell with a higher level of specificity is selected through this process (affinity maturation) (Non Patent Literature 5).

A T cell or a B cell produces one type of TCR or BCR with a high level of specificity to a specific antigen. With numerous antigen specific T cells and B cells in a living organism, a diverse TCR repertoire or BCR repertoire can be formed to effectively function as a defense mechanism against various pathogens. Thus, analysis of a TCR or BCR repertoire, which is an important indicator of specificity or diversity of immune cells, is a useful analytical tool for analyzing monoclonality or immune disorder. If T cells or B cells proliferate in response to an antigen, the ratio of a specific TCR or BCR gene is observed to increase in a diverse repertoire (increased clonality). An attempt has been made to detect development of tumor in lymphoid cells expressing TCRs or BCRs in terms of increase in clonality by TCR or BCR repertoire analysis (Non Patent Literature 6). Further, it is reported that the usage frequency of a specific Vβ chain increases when exposed to a molecule that selectively stimulates a TCR having a specific Vβ chain such as super antigens (Non Patent Literature 7). In order to investigate antigen specific immune responses, it is frequently used in analysis of refractory autoimmune diseases that are induced by immune disorders such as rheumatoid arthritis, systemic lupus erythematosus, Sjögren's syndrome, and idiopathic thrombocytopenic purpura, and the usefulness thereof has been demonstrated.

Conventional TCR repertoire analysis is an analytic method for examining how many individual V chains are used by T cells in a sample. One of the methods is a method of analyzing the ratio of T cells expressing individual Vβ chains by using a specific Vβ chain specific antibody with flow cytometry (FACS analysis). Since a relatively large number of cells are required, this technology is useful for analyzing peripheral blood comprising many lymphocytes, but cannot be adapted to a tissue material sample. Further, since an antibody that is compatible with all of the V chains is still not available today, comprehensive analysis is not possible.

In addition thereto, TCR repertoire analysis using molecular biological technology has been designed based on information on TCR genes obtained from the human genomic sequence. This is a method of extracting an RNA from a cell sample to synthesize a complementary DNA and then amplifying and quantifying a TCR gene by PCR. It has been conventional to use a method of designing numerous individual TCR V chain specific primers to separately quantify by real-time PCR or the like, or a method of simultaneously amplifying such specific primers (Multiple PCR). However, even in quantification using an endogenous control for each V chain, accurate analysis is not possible when a large number of primers are used. Furthermore, multiple PCR has a disadvantage in that a difference in efficiency of amplification among primers results in a bias in PCR amplification. In order to overcome such a disadvantage of multiple PCR, Tsuruta et al reported Adaptor-ligation PCR, which adds an adaptor to the 5' terminal of a double stranded complementary DNA of a TCR gene and then amplifies all γδ TCR genes with a common adaptor primer and a C region specific primer (Non Patent Literature 8). Furthermore, methods applied to amplification of αβ TCR genes for quantification with oligoprobes specific to individual V chains were developed, i.e., Reverse dot blot (Non Patent Literature 9) and Microplate hybridization assay (Non Patent Literature 10). They are excellent methods for amplifying a TCR gene without introducing a bias. However, hardly any information other than the usage frequency of V chains can be obtained. Base sequence information or the like of a CDR3 region, the J chain, D chain or antigen recognition site, required subsequent cloning of a complement chain DNA of a TCR gene and determination of the base sequence.

In recent years, rapidly advancing next generation sequence analysis techniques have enabled large scale base sequence determination of genes. By amplifying a TCR gene from a human sample by PCR and using a next generation sequence analysis technique, it is possible to materialize a next generation TCR repertoire analysis method for obtaining and analyzing more detailed clone level genetic information from TCR repertoire analysis for obtaining information that has been small scale and limited to V chain usage frequency or the like. In this context, few next generation TCR repertoire analysis methods have been developed (Patent Literatures 1 and 2) while other attempts have also been made (Patent Literatures 3-11).

CITATION LIST

Patent Literature

[PTL 1] International Publication No. WO 2009/137255
[PTL 2] International Publication No. WO 2013/059725
[PTL 3] Japanese Laid-Open Publication No. 10-229897
[PTL 4] Japanese National Phase PCT Laid-open Publication No. 2007-515154
[PTL 5] Japanese National Phase PCT Laid-open Publication No. 2012-508011
[PTL 6] Japanese Laid-Open Publication No. 2013-116116
[PTL 7] Japanese National Phase PCT Laid-open Publication No. 2013-524848
[PTL 8] Japanese National Phase PCT Laid-open Publication No. 2013-524849
[PTL 9] International Publication No. WO 2013/033721 A1
[PTL 10] International Publication No. WO 2013/043922 A1
[PTL 11] International Publication No. WO 2013/044234 A1

Non Patent Literature

[NPL 1] Cell 1994, 76, 287-299
[NPL 2] Nucleic Acid Research, 2009, 37 (suppl1), D1006-D1012.
[NPL 3] Annual Review Immunology, 1993, 6, 309-326
[NPL 4] Annual Review Immunology, 2000, 18, 495-527
[NPL 5] Proc Natl Acad Sci, 1993, 90, 2385-2388
[NPL 6] Leukemia Research, 2003, 27, 305-312
[NPL 7] Immunology 1999, 96, 465-72.
[NPL 8] Journal of Immunological Methods, 1994, 169, 17-23
[NPL 9] Journal of Immunological Methods, 1997, 201, 145-15.
[NPL 10] Human Immunology, 1997, 56, 57-69

SUMMARY OF INVENTION

Solution to Problem

The present invention is an invention related to an analysis method and analysis system applied to (1) a technique for amplifying a TCR or BCR genetic sequence produced by gene rearrangement from multiple gene fragments in a genome without applying a bias (unbiased gene amplification technique), and (2) a technology for determining the base sequence of a TCR or BCR gene amplified by the unbiased gene amplification technique in a large scale by a next generation sequencing method, assigning V, D, J, and C regions, and analyzing a TCR repertoire or BCR repertoire.

Diverse genetic sequences are created by gene rearrangement of multiple gene fragments of V, D, J, and C regions on a genome for TCRs or BCRs. A technology of producing numerous primers specific to numerous V or J regions that are present and amplifying in the same or separate reaction solution is widely utilized to determine a base sequence of a TCR or BCR gene by a next generation sequencing technique. However, the difference in amplification efficiency among primers would be a critical issue in PCR amplification which exponentially amplifies a small amount of gene. Further, it is necessary that primers set to V and J regions are compatible with all known allelic sequences. A point mutation is introduced at a high frequency (up to about 20%) in a variable section region of IgG, IgA or IgE by a somatic hypermutation mechanism for a BCR gene. Thus, if a 20 base primer is set, about 4 bases would have a mismatch. Hence, it is difficult to materialize uniform gene amplification with a conventional method. That is, known methods of designing a V chain specific primer based on a genomic sequence cannot avoid a mismatch with the actual BCR genetic sequence such that quantitative gene amplification is not guaranteed. Furthermore, a BCR has an isotype and a subclass defined by a C region sequence. It is necessary to develop a quantification method for each isotype or subclass utilizing a difference in the base sequence among isotypes or subclasses. In order to overcome the disadvantage of a technology using a V chain specific primer currently in use, the inventors have completed a method of amplifying a TCR or BCR gene including all isotype and subtype genes with a set of primers consisting of one type of forward primer and one type of reverse primer without changing the frequency of presence and determining a base sequence in a large scale by using a next generation sequencing.

Focus was placed on the genetic structure of a TCR or BCR gene. An adaptor sequence is added, without setting a primer to highly diverse V regions, to a 5' terminal thereof to amplify a gene comprising all V regions.

Such an adaptor can have any length or sequence in a base sequence. About 20 base pairs are optimal, but a sequence from 10 bases to 100 bases can be used.

An adaptor added to the 3' terminal is removed with a restriction enzyme. In addition, all TCR or BCR genes are amplified by amplifying with a reverse primer specific to a C region which has a common sequence with an adaptor primer with the same sequence as a 20 base pair adaptor.

A complementary strand DNA is synthesized with a reverse transcriptase from a TCR or BCR gene messenger RNA and then a double stranded complementary DNA is synthesized. A double stranded complementary DNA comprising V regions with different lengths is synthesized by a reverse transcription reaction or a double strand synthesizing reaction. Adaptors consisting of 20 base pairs and 10 base pairs are added to the 5' terminal section of such genes by a DNA ligase reaction.

The genes can be amplified by setting a reverse primer in a C region of a heavy chain of µ chain, α chain, δ chain, γ chain or ε chain or a light chain of κ chain or λ chain for BCRs and α chain, β chain, γ chain or δ chain for TCRs.

As a reverse primer set in a C region, a primer is set which matches the sequence of each of Cβ, Cα, Cγ and Cδ for TCRs and the sequence of each of Cµ, Cα, Cδ, Cγ, Cε, Cκ, and Cλ for BCRs and has a mismatch to an extent where other C region sequences are not primed.

A reverse primer of a C region is optimally made while considering the base sequence, base composition, DNA melting temperature (Tm), or presence of a self-complementary sequence, such that amplification with an adaptor primer is possible.

Each BCR gene IgG subtype (γ1, γ2, γ3, and γ4) and IgA subtype (α1 and α2) can be amplified with the same primer to determine the subtype by determining the base sequence.

A primer can be set in a region other than the base sequence that is different among allelic sequences in a C region sequence to uniformly amplify all alleles.

A plurality of stages of nested PCR are performed in order to enhance the specificity of an amplification reaction.

The length (number of bases) of a primer candidate sequence is not particularly limited for a sequence not comprising a sequence that is different among allelic sequences for each primer. However, the number of bases is 10-100, preferably 15-50, and more preferably 20-30. Thus, the present invention also provides the following.

<In Silico>

In one aspect, the present invention relates to a technology for analyzing a TCR or BCR repertoire based on a group of expressed TCRs or BCR genetic sequences derived from a biological sample.

The present invention is not dependent on the model of sequencer for any V(-D)-J-C series nucleic acid sequence. Classification itself is possible even without unbiasness. The input can be either a plus strand or complementary strand.

For classification of nucleic acid sequences, it is common to set a reference database that has accumulated standard sequences serving as the baseline of classification (hereinafter, referred to as reference sequence) and assign each nucleic acid sequence to one of the reference sequences by a technology for homology search. However, it is necessary in this case to prepare an enormous number of reference sequences from combining each region of V, D, and J, which is not practical. A technology of setting a reference database for each of V, D, and J is conceivable. However, the difference from a reference sequence would be large due to a random mutation in V. Further, D and J have a short region. Thus, the possibility of oversight cannot be ignored for a common homology search technology. A technology of translating the entire nucleic acid sequence of a subject of analysis into an amino acid sequence and classifying the sequence by materials is conceivable. However, such a technology would be vulnerable especially to sequencing error from insertion/deletion and the relationship with previously-reported gene names and alleles would be unknown, such that it would be difficult to use known information.

The reference database used in the present invention is prepared for each of V. D, and J (and C for BCR) gene regions. Typically, a nucleic acid sequence data set is used for each allele or each region published by the IMGT, but is not limited thereto. Any data set with a unique ID assigned to each sequence can be used.

For the input sequence set used in the present invention, an adaptor sequence or low quality region is generally trimmed in advance and only a sequence with an sufficient length for analysis is extracted to construct a high quality set. This step is not necessarily required, but is used in a preferred embodiment. This is because, even without such processing, an LQ sequence would simply be "unclassifiable".

The input sequence set used in the present invention searches for homology with a reference database for each gene region and records an alignment with the closest reference allele and the sequence thereof. In this regard, an algorithm with high tolerance for a mismatch except for C is used for homology search. For instance, when a common homology search program such as BLAST is used, setting such as shortening of the window size, reduction in mismatch penalty, or reduction in gap penalty is set for each region. The closest reference allele is selected by using a homology score, alignment length, kernel length (length of consecutively matching base sequence) and number of matching bases as indicators applied in accordance with a defined order or priority.

For the input sequence with determined V and J used in the present invention, a CDR3 sequence is extracted with the front of CDR3 on reference V and end of CDR3 on reference J as guides. This is translated into an amino acid sequence for use in classification of a D region. When a reference database of a D region is prepared, a combination of results of homology search and results of amino acid sequence translation is used as a classification result.

In view of the above, each allele of V, D and J (and C for BCR) is assigned for each sequence in an input set. The frequency of appearance by each of V, D and J (and C for BCR) or frequency of appearance of a combination thereof in the entire input set is subsequently calculated to derive a TCR or BCR repertoire. The frequency of appearance is calculated in a unit of allele or unit of gene name depending on the precision required in classification. The latter is possible by translating each allele to a gene name. Thus, the present invention also provides the following.

<1> A method of analyzing a TCR or BCR repertoire, comprising the following steps:

(1) providing a reference database for each gene region comprising at least one of a V region, a D region, a J region and optionally a C region;

(2) providing an input sequence set which is optionally trimmed and optionally extracted to have a suitable length;

(3) searching for homology of the input sequence set with the reference database for the each gene region and recording an alignment with an approximate reference allele and/or a sequence of the reference allele;

(4) assigning the V region and the J region for the input sequence set and extracting a nucleic acid sequence of the D region based on a result of assigning;

(5) translating the nucleic acid sequence of the D region into an amino acid sequence and classifying the D region by utilizing the amino acid sequence; and (6) calculating a frequency of appearance for each of the V region, the D region, and the J region and optionally the C region or a frequency of appearance of a combination thereof based on the classifying in (5) to derive the TCR or BCR repertoire.

<2> The method of item <1>, wherein the gene region comprises all of the V region, the D region, the J region and optionally the C region.

<3> The method of any one of items <1>-<2>, wherein the reference database is a database with a unique ID assigned to each sequence.

<4> The method of any one of items <1>-<3>, wherein the input sequence set is an unbiased sequence set.

<5> The method of any one of items <1>-<4>, wherein the sequence set is trimmed.

<6> The method of any one of items <1>-<5>, wherein the trimming is accomplished by the steps of: deleting low quality regions from both ends of a read; deleting a region matching 10 bp or more with an adaptor sequence from the both ends of the read; and using the read as a high quality read in analysis when a remaining length is 200 bp or more (TCR) or 300 bp or more (BCR).

<7> The method of item <6>, wherein the low quality refers to a 7 bp moving average of QV value less than 30.

<8> The method of any one of items <1>-<7>, wherein the approximate sequence is the closest sequence.

<9> The method of any one of items <1>-<8>, wherein the approximate sequence is determined by a ranking of 1. number of matching bases, 2. kernel length, 3. score, and 4. alignment length.

<10> The method of any one of items <1>-<9>, wherein the homology search is conducted under a condition tolerating random mutations to be scattered throughout.

<11> The method of any one of items <1>-<10>, wherein the homology search comprises at least one condition from (1) shortening of a window size, (2) reduction in a mismatch penalty, (3) reduction in a gap penalty, and (4) a top priority ranking of an indicator is a number of matching bases, compared to a default condition.

<12> The method of any one of items <1>-<11>, wherein the homology search is carried out under the following conditions in BLAST or FASTA:

mismatch penalty=−1, shortest alignment length=30, and shortest kernel length=15;

D word length=7 (for BLAST) or K-tup=3 (for FASTA), mismatch penalty=−1, gap penalty=0, shortest alignment length=11, and shortest kernel length=8;

J mismatch penalty=−1, shortest hit length=18, and shortest kernel length=10; and C shortest hit length=30 and shortest kernel length=15.

<13> The method of any one of items <1>-<12>, wherein the D region is classified by a frequency of appearance of the amino acid sequence.

<14> The method of any one of items <1>-<13>, wherein a combination of a result of search for homology with the nucleic acid sequence of CDR3 and a result of amino acid sequence translation is used as a classification result when there is a reference database for the D region in the step (5).

<15> The method of any one of items <1>-<14>, wherein only the frequency of appearance of the amino acid sequence is used for classification when there is no reference database for the D region in the step (5).

<16> The method of any one of items <1>-<15>, wherein the frequency of appearance is counted in a unit of a gene name and/or a unit of an allele.

<17> The method of any one of items <1>-<16>, wherein the step (4) comprises the step of assigning the V region and the J region for the input sequence set and extracting a CDR3 sequence, with the front of CDR3 on a reference V region and end of CDR3 on reference J as guides.

<18> The method of any one of items <1>-<17>, wherein the step (5) comprises translating the nucleic acid sequence of the CDR3 into an amino acid sequence and classifying a D region by using the amino acid sequence.

<19> A system for analyzing a TCR or BCR repertoire, wherein the system comprises:
(1) means for providing a reference database for each gene region comprising at least one of a V region, a D region, a J region and optionally a C region;
(2) means for providing an input sequence set which is optionally trimmed and optionally extracted to have a suitable length;
(3) means for searching for homology of the input sequence set with the reference database for the each gene region and recording an alignment with an approximate reference allele and/or a sequence of the reference allele;
(4) means for assigning the V region and the J region for the input sequence set and extracting a nucleic acid sequence of the D region based on a result of assigning;
(5) means for translating the nucleic acid sequence of the D region into an amino acid sequence and classifying the D region by utilizing the amino acid sequence; and
(6) means for calculating a frequency of appearance for each of the V region, the D region, and the J region and optionally the C region or a frequency of appearance of a combination thereof in the input sequence set to derive the TCR or BCR repertoire.

<19A> The system of item <19> having one or more features of any one of items <1>-<18>.

<20> A computer program for having a computer execute processing of a method of analyzing a TCR or BCR repertoire, the method comprising the following steps:
(1) providing a reference database for each gene region comprising at least one of a V region, a D region, a J region and optionally a C region;
(2) providing an input sequence set which is optionally trimmed and optionally extracted to have a suitable length;
(3) searching for homology of the input sequence set with the reference database for the each gene region and recording an alignment with an approximate reference allele and/or a sequence of the reference allele;
(4) assigning the V region and the J region for the input sequence set and extracting a nucleic acid sequence of the D region based on a result of assigning;
(5) translating the nucleic acid sequence of the D region into an amino acid sequence and classifying the D region by utilizing the amino acid sequence; and
(6) calculating a frequency of appearance for each of the V region, the D region, and the J region and optionally the C region or a frequency of appearance of a combination thereof in the input sequence set to derive the TCR or BCR repertoire.

<20A> The program of item <20> having one or more features of any one of items <1>-<18>.

<21> A recording medium for storing a computer program for having a computer execute processing of a method of analyzing a TCR or BCR repertoire, the method comprising the following steps:
(1) providing a reference database for each gene region comprising at least one of a V region, a D region, a J region and optionally a C region;
(2) providing an input sequence set which is optionally trimmed and optionally extracted to have a suitable length;
(3) searching for homology of the input sequence set with the reference database for the each gene region and recording an alignment with an approximate reference allele and/or a sequence of the reference allele;
(4) assigning the V region and the J region for the input sequence set and extracting a nucleic acid sequence of the D region based on a result of assigning;
(5) translating the nucleic acid sequence of the D region into an amino acid sequence and classifying the D region by utilizing the amino acid sequence; and
(6) calculating a frequency of appearance for each of the V region, the D region, and the J region and optionally the C region or a frequency of appearance of a combination thereof in the input sequence set to derive the TCR or BCR repertoire.

<21A> The recording medium of item <21> having one or more features of any one of items <1>-<18>.

<Wet>

In another aspect, the present invention is (1) a technology for uniformly amplifying a TCR or BCR genetic sequence produced by gene rearrangement from a plurality of gene fragments in a genome without applying a bias (unbiased gene amplification technology), and (2) a technology for determining the base sequence of a TCR or BCR gene amplified by the unbiased gene amplification technology in a large scale by a next generation sequencing method, assigning V, D, J, and C regions, and analyzing a TCR repertoire or BCR repertoire.

Diverse genetic sequences are created by gene rearrangement of a plurality of gene fragments of V, D, J, and C regions on a genome for TCRs or BCRs. A technology of producing a large number of primers specific to many V or J regions that are present and amplifying in the same reaction solution or separate reaction solutions is widely utilized to determine a base sequence of a TCR or BCR gene by a next generation sequencing technique. However, a difference in amplification efficiency among primers would be a critical issue in PCR amplification which exponentially amplifies a small amount of gene. Further, it is necessary that primers set to V and J regions are compatible with all known allelic sequences. A point mutation is introduced at a high frequency (up to about 20%) in a variable section region of IgG, IgA or IgE by a somatic hypermutation mechanism for a BCR gene. Thus, if a 20 base primer is set, about 4 bases would have a mismatch. Hence, it is difficult to materialize uniform gene amplification with a conventional method. That is, known methods of designing a V chain specific primer based on a genomic sequence cannot avoid a mismatch with the actual BCR genetic sequence such that quantitative gene amplification is not guaranteed. Furthermore, a BCR has an isotype and a subclass defined by a C region sequence. It is necessary to develop a quantification method for each isotype or subclass utilizing a difference in the base sequence among isotypes or subclasses. In order to overcome the disadvantage of a technology using a V chain specific primer current in use, the inventors have completed a method of amplifying a TCR or BCR gene including all isotype and subtype genes with a set of primers consisting of one type of forward primer and one type of reverse primer without changing the frequency of presence and determining a base sequence in a large scale by using a next generation sequencing.

Focus was placed on the genetic structure of a TCR or BCR gene. An adaptor sequence is added, without setting a primer to highly diverse V regions, to a 5' terminal thereof to amplify a gene comprising all V regions.

Such an adaptor can have any length or sequence in a base sequence. About 20 base pairs are optimal, but a sequence from 10 bases to 100 bases can be used.

An adaptor added to the 3' terminal is removed with a restriction enzyme. In addition, all TCR or BCR genes are amplified by amplifying with a reverse primer specific to a C region which has a common sequence with an adaptor primer with the same sequence as a 20 base pair adaptor.

A complementary strand DNA is synthesized with a reverse transcriptase from a TCR or BCR gene messenger RNA and then a double stranded complementary DNA is synthesized. A double stranded complementary DNA comprising V regions with different lengths is synthesized by a reverse transcription reaction or a double strand synthesizing reaction. Adaptors consisting of 20 base pairs and 10 base pairs are added to the 5' terminal section of such genes by a DNA ligase reaction.

The genes can be amplified by setting a reverse primer in a C region of a heavy chain of μ chain, α chain, δ chain, γ chain or ε chain or a light chain of κ chain or λ chain for BCRs and α chain, β chain, γ chain or δ chain for TCRs.

As a reverse primer set in a C region, a primer is set which matches the sequence of each of Cβ, Cα, Cγ and Cδ for TCRs and the sequence of each of Cμ, Cα, Cδ, Cγ, Cε, Cκ, and Cλ for BCRs and has a mismatch to an extent where other C region sequences are not primed.

A reverse primer of a C region is optimally made while considering the base sequence, base composition, DNA melting temperature (Tm), or presence of a self-complementary sequence, such that amplification with an adaptor primer is possible.

Each BCR gene IgG subtype (γ1, γ2, γ3, and γ4) and IgA subtype (α1 and α2) can be amplified with the same primer to determine the subtype by determining the base sequence.

A primer can be set in a region other than the base sequence that is different among allelic sequences in a C region sequence to uniformly amplify all alleles.

A plurality of stages of nested PCR are performed in order to enhance the specificity of an amplification reaction.

The length (number of bases) of a primer candidate sequence is not particularly limited for a sequence not comprising a sequence that is different among allelic sequences for each primer. However, the number of bases is 10-100, preferably 15-50, and more preferably 20-30. Thus, the present invention also provides the following.

<A1> A method of preparing a sample for quantitative analysis of a repertoire of a variable region of a T cell receptor (TCR) or B cell receptor (BCR) by genetic sequence analysis using a database, comprising the steps of:
(1) synthesizing a complementary DNA by using an RNA sample derived from a target cell as a template;
(2) synthesizing a double stranded complementary DNA by using the complementary DNA as a template;
(3) synthesizing an adaptor-added double stranded complementary DNA by adding a common adaptor primer sequence to the double stranded complementary DNA;
(4) performing a first PCR amplification reaction by using the adaptor-added double stranded complementary DNA, a common adaptor primer consisting of the common adaptor primer sequence, and a first TCR or BCR C region specific primer,
wherein the first TCR or BCR C region specific primer is designed to comprise a sequence that is sufficiently specific to a C region of interest of the TCR or BCR and not homologous with other genetic sequences, and comprise a mismatching base between subtypes downstream when amplified;
(5) performing a second PCR amplification reaction by using a PCR amplicon of (4), the common adaptor primer, and a second TCR or BCR C region specific primer, wherein the second TCR or BCR C region specific primer is designed to have a sequence that is a complete match with the TCR or BCR C region in a sequence downstream the sequence of the first TCR or BCR C region specific primer, but comprise a sequence that is not homologous with other genetic sequences, and comprise a mismatching base between subtypes downstream when amplified; and
(6) performing a third PCR amplification reaction by using a PCR amplicon of (5), an added common adaptor primer in which a nucleic acid sequence of the common adaptor primer comprises a first additional adaptor nucleic acid sequence, and an adaptor-added third TCR or BCR C region specific primer in which a second additional adaptor nucleic acid sequence and a molecule identification (MID Tag) sequence are added to a third TCR or BCR C region specific sequence; wherein
the third TCR or BCR C region specific primer is designed to have a sequence that is a complete match with the TCR or BCR C region in a sequence downstream to the sequence of the second TCR or BCR C region specific primer, but comprise a sequence that is not homologous with other genetic sequences, and comprise a mismatching base between subtypes downstream when amplified,
the first additional adaptor nucleic acid sequence is a sequence suitable for binding to a DNA capturing bead and for an emPCR reaction,
the second additional adaptor nucleic acid sequence is a sequence suitable for an emPCR reaction, and
the molecule identification (MID Tag) sequence is a sequence for imparting uniqueness such that an amplicon can be identified.
<A2> The method of item <A1>, wherein, for a BCR, the C region specific primer comprises a sequence that is a complete match with an isotype C region of interest selected from the group consisting of IgM, IgA, IgG, IgE and IgD and is not homologous with other C regions, and is a sequence that is a complete match with one of the subtypes IgG1, IgG2, IgG3 and IgG4 or one of IgA1 or IgA2 for IgA or IgG, or, for a TCR, the C region specific primer is a sequence that is a complete match with a C region of a chain of interest selected from the group consisting of α chain, β chain, γ chain and δ chain and is not homologous with other C regions.

<A3> The method of item <1> or <A2>, wherein a portion of a sequence that is a complete match with all C region allelic sequences of the same isotype in the database is selected for the C region specific primer.

<A4> The method of any one of items <A1>-<A3>, wherein the common adaptor primer is designed such that the primer is unlikely to have homodimer and intramolecular hairpin structures and can stably form a double strand, and designed not to be highly homologous with all TCR genetic sequences in the database and to have the same level of melting temperature (Tm) as the C region specific primer.

<A5> The method of item <A4>, wherein the common adaptor primer designed not to have homodimer and intramolecular hairpin structures and to have homology with other genes comprising a BCR or TCR is selected.

<A6> The method of item <A5>, wherein the common adaptor primer is P20EA (SEQ ID NO: 2) and/or P10EA (SEQ ID NO: 3).

<A7> The method of any one of items <A1>-<A6>, wherein the first, second and third TCR or BCR C region specific primers are each independently a primer for BCR repertoire analysis, the primer being selected to be a sequence that is a complete match with each isotype C region of IgM, IgG, IgA, IgD or IgE, and a complete match with subtypes for IgG and IgA, and not homologous with other sequences comprised in the database, and comprise a mismatching base between subtypes downstream of the primer, and
wherein the common adaptor primer sequence is designed such that the sequence has a base length suitable for amplification, is unlikely to have homodimer and intramolecular hairpin structures, and is able to stably form a double strand, and designed not to be highly homologous with all TCR genetic sequences in the database and to have the same level of Tm as the C region specific primer.

<A8> The method of any one of items <A1>-<A7>, wherein the first, second and third TCR or BCR C region specific primers are each independently a primer for TCR or BCR repertoire analysis, each primer being selected to be a sequence that is a complete match with 1 type of α chain (TRAC), 2 types of β chains (TRBCO1 and TRBCO2), 2 types of γ chains (TRGC1 and TRGC2), and one type of δ chain (TRDC1) and is not homologous with other sequences comprised in the database, and to comprise a mismatching base between subtypes downstream of the primer,
wherein the common adaptor primer sequence is designed such that the sequence has a base length suitable for amplification, is unlikely to have homodimer and intramolecular hairpin structures, and is able to stably form a double strand, and designed not to be highly homologous with all TCR genetic sequences in the database and to have the same level of Tm as the C region specific primer.

<A9> The method of any one of items <A1>-<A8>, wherein the third TCR or BCR C region specific primer is set in a region that is up to about 150 bases from the 5' terminal side of a C region, and the first TCR or BCR C region specific primer and the second TCR or BCR C region specific primer are set between the 5' terminal side of a C region to about 300 bases.

<A10> The method of any one of items <A1>-<A9>, wherein the first, second and third TCR or BCR C region specific primers are each independently for BCR quantitative analysis,
wherein separate specific primers are set to 5 types of isotype sequences, and the primers are designed to completely match a target sequence and ensure a mismatch of 5 bases or more for other isotypes and are designed to be a complete match with all subtypes such that one type of primer is compatible with each similar IgG subtype (IgG1, IgG2, IgG3 and IgG4) or IgA subtype (IgA1 and IgA2).

<A11> The method of any one of items <A1>-<A10>, wherein parameters in primer design are set to: a base sequence length of 18-22 bases; a melting temperature of 54-66° C.; and % GC (% guanine·cytosine content) of 40-65%.

<A12> The method of any one of items <A1>-<A11>, wherein parameters in primer design are set to: a base sequence length of 18-22 bases; a melting temperature of 54-66° C.; and % GC (% guanine·cytosine content) of 40-65%; a self-annealing score of 26; a self-end annealing score of 10; and a secondary structure score of 28.

<A13> The method of any one of items <A1>-<A12>, wherein sequences of the first, second and third TCR or BCR C region specific primers are determined under the following conditions:
1. a plurality of subtype sequences and/or allelic sequences are uploaded into a base sequence analysis software and aligned;
2. a primer designing software is used to search for a plurality of primers satisfying a parametric condition in a C region;
3. a primer in a region without a mismatching base in the aligned sequences in 1 is selected; and
4. the presence of a plurality of mismatching sequences for each subtype and/or allele downstream of the primer determined in 3 is confirmed, and if there is no such sequence, a primer is searched further upstream, which is further repeated as needed.

<A14> The method of any one of items <A1>-<A13>, wherein the first TCR or BCR C region specific primer is set in a position at bases 41-300 with a first base of a first codon of a C region sequence produced by splicing as a baseline, the second TCR or BCR C region specific primer is set in a position at bases 21-300 with said first base as the baseline, and the third TCR or BCR C region specific primer is set in a position within 150 bases or less with said first base as the baseline, and the positions comprise a mismatching site in a subtype and/or allele.

<A15> The method of any one of items <A1>-<A14>, wherein the first TCR or BCR C region specific primer has the following structure: CM1 (SEQ ID NO: 5), CA1 (SEQ ID NO: 8), CG1 (SEQ ID NO: 11), CD1 (SEQ ID NO: 14), CE1 (SEQ ID NO: 17), CA1 (SEQ ID NO: 35) or CB1 (SEQ ID NO: 37).

<A16> The method of any one of items <A1>-<A15>, wherein the second TCR or BCR C region specific primer has the following structure: CM2 (SEQ ID NO: 6), CA2 (SEQ ID NO: 9), CG2 (SEQ ID NO: 12), CD2 (SEQ ID NO: 15), CE2 (SEQ ID NO: 18), CA2 (SEQ ID NO: 35), or CB2 (SEQ ID NO: 37).

<A17> The method of any one of items <A1>-<A16>, wherein the third TCR or BCR C region specific primer has the following structure: CM3-GS (SEQ ID NO: 7), CA3-GS (SEQ ID NO: 10), CG3-GS (SEQ ID NO: 13), CD3-GS (SEQ ID NO: 16) or CE3-GS (SEQ ID NO: 19).

<A18> The method of any one of items <A1>-<A17>, wherein each of the TCR or BCR C region specific primers is provided in a set compatible with all TCR or BCR subclasses.
<A19> A method of performing gene analysis using a sample manufactured by the method of any one of items <A1>-<A18>.
<A20> The method of item <A19>, wherein the gene analysis is the quantitative analysis of a repertoire of a variable region of a T cell receptor (TCR) or a B cell receptor (BCR).
<Analysis System>
<B1> A method of quantitatively analyzing a repertoire of a variable region of a T cell receptor (TCR) or a B cell receptor (BCR) of a subject by using a database, wherein the method comprises:
(1) providing a nucleic acid sample comprising a nucleic acid sequence of the T cell receptor (TCR) or the B cell receptor (BCR) which is amplified from the subject in an unbiased manner;
(2) determining the nucleic acid sequence comprised in the nucleic acid sample; and
(3) calculating a frequency of appearance of each gene or a combination thereof based on the determined nucleic acid sequence to derive a TCR or BCR repertoire of the subject.
<B2> The method of item <B1>, wherein the nucleic acid sample comprises nucleic acid sequences of a plurality of types of T cell receptors (TCR) or B cell receptors (BCR) and the step (2) determines the nucleic acid sequence by a single sequencing.
<B3> The method of item <B2>, wherein the single sequencing is characterized in that at least one of the sequences used as a primer in amplification from the nucleic acid sample into a sample for sequencing has the same sequence as a nucleic acid sequence encoding a C region or a complementary strand thereof.
<B4> The method of item <B2> or <B3>, wherein the single sequencing is characterized in being performed with a common adaptor primer.
<B5> The method of any one of items <B1>-<B4>, wherein the unbiased amplification is not V region specific amplification.
<B6> The method of any one of <B1>-<B5>, wherein the repertoire is the repertoire of a variable region of a BCR, and the nucleic acid sequence is a BCR nucleic acid sequence.
<B7> A method of analyzing a disease, disorder or condition of the subject based on the TCR or BCR repertoire derived based on any one of <B1>-<B6>,
<B8> The method of item <B7>, wherein the disease, disorder or condition of the subject is selected from the group consisting of hematological tumor and colorectal cancer.
<B9> A method of treating or preventing the disease, disorder or condition of the subject determined by the method of item <B7> or <B8>, comprising: quantitatively associating the disease, disorder or condition of the subject with the TCR or BCR repertoire; and selecting means for suitable treatment or prevention from the quantitative association.
<B10> The method of item <B9>, wherein the disease, disorder or condition of the subject is selected from the group consisting of hematological tumor and colorectal cancer.
<B11> A system for quantitatively analyzing a repertoire of a variable region of a T cell receptor (TCR) or a B cell receptor (BCR) of a subject by using a database, wherein the system comprises:

(1) a kit for providing a nucleic acid sample comprising a nucleic acid sequence of the T cell receptor (TCR) or the B cell receptor (BCR) which is amplified from the subject in an unbiased manner;
(2) an apparatus for determining the nucleic acid sequence comprised in the nucleic acid sample; and
(3) an apparatus for calculating a frequency of appearance of each gene or a combination thereof based on the determined nucleic acid sequence to derive a TCR or BCR repertoire of the subject.
<B12> The system of item <B11>, wherein the nucleic acid sample comprises nucleic acid sequences of a plurality of types of T cell receptors (TCR) or B cell receptors (BCR) and the step (2) determines the nucleic acid sequence by a single sequencing.
<B13> The system of item <B12>, wherein the single sequencing is characterized in that at least one of the sequences used as a primer in amplification from the nucleic acid sample to a sample for sequencing has the same sequence as a C region.
<B14> The system of item <B12> or <B13>, wherein the single sequencing is characterized in being performed with a common adaptor primer.
<B15> The system of any one of items <B11>-<B14>, wherein the unbiased amplification is not V region specific amplification.
<B16> The system of any one of items <B11>-<B15>, wherein the repertoire is the repertoire of a variable region of a BCR, and the nucleic acid sequence is a BCR nucleic acid sequence.
<B17> A system of analyzing a disease, disorder or condition of the subject, comprising the system of any one of items <B11>-<B16> and means for analyzing the disease, disorder or condition of the subject based on the TCR or BCR repertoire derived based the system.
<B18> The system of item <B17>, wherein the disease disorder or condition of the subject is selected from the group consisting of hematological tumor and colorectal cancer.
<B19> A system of treating or preventing the disease, disorder or condition of the subject determined by the system of item <B17> or <B18>, comprising: means for quantitatively associating the disease, disorder or condition of the subject with the TCR or BCR repertoire; and means for selecting means for suitable treatment or prevention from the quantitative association.
<B20> The system of item <B19>, wherein the disease, disorder or condition of the subject is selected from the group consisting of hematological tumor and colorectal cancer.
<B21> A monoclonal T cell related to T cell large granular lymphocytic leukemia (T-LGL) expressing TCRα comprising TRAV10/TRAJ15/CVVRATGTALIFG (SEQ ID NO: 1450) or a nucleic acid encoding the same and/or TCRβ comprising TRBV29-1/TRBJ2-7/CSVERGGSLGEQYFG (SEQ ID NO: 1500) or a nucleic acid encoding the same.
<B22> Use of TRAV10/TRAJ15/CVVRATGTALIFG (SEQ ID NO: 1450) or a nucleic acid encoding the same in TCRα and/or TRBV29-1/TRBJ2-7/CSVERGGSLGEQYFG (SEQ ID NO: 1500) or a nucleic acid encoding the same in TCRβ as a diagnostic indicator of T cell large granular lymphocytic leukemia (T-LGL).
<B23> A method of detecting T cell large granular lymphocytic leukemia (T-LGL), comprising detecting TRAV10/TRAJ15/CVVRATGTALIFG (SEQ ID NO: 1450) or a nucleic acid encoding the same in TCRα and/or TRBV29-

1/TRBJ2-7/CSVERGGSLGEQYFG (SEQ ID NO: 1500) or a nucleic acid encoding the same in TCRβ.

<B24> An detecting agent for TRAV10/TRAJ15/CVVRATGTALIFG (SEQ ID NO: 1450) or a nucleic acid encoding the same in TCRα and/or a detecting agent for TRBV29-1/TRBJ2-7/CSVERGGSLGEQYFG (SEQ ID NO: 1500) or a nucleic acid encoding the same in TCRβ.

<B25> A diagnostic agent for T cell large granular lymphocytic leukemia (T-LGL) comprising a detecting agent for TRAV10/TRAJ15/CVVRATGTALIFG (SEQ ID NO: 1450) or a nucleic acid encoding the same in TCRα and/or a detecting agent for TRBV29-1/TRBJ2-7/CSVERGGSLGEQYFG (SEQ ID NO: 1500) or a nucleic acid encoding the same in TCRβ.

<B26> A peptide which is a novel invariant TCR, comprising any one of the sequences set forth in SEQ ID NOs: 1627-1647.

<B27> An indicator peptide of a mucosal-associated invariant T (MAIT) cell, comprising a sequence selected from the group consisting of SEQ ID NOs 1648-1651, 1653-1654, 1666-1667, 1844-1848, and 1851.

<B28> A nucleic acid encoding the peptide of item <B27>.

<B29> Use of the peptide of item <B27> or <B28> or a nucleic acid encoding said peptide as a diagnostic indicator of colorectal cancer.

<B30> An indicator peptide of a natural killer T cell (NKT), comprising the sequence set forth in SEQ ID NO: 1668.

<B31> A nucleic acid encoding the peptide of item <B30>.

<B32> Use of the peptide of item <B30> or <B31> or a nucleic acid encoding said peptide as a diagnostic indicator of colorectal cancer.

<B33> A colorectal cancer-specific peptide, comprising a sequence selected from the group consisting of SEQ ID NOs: 1652, 1655-1665, 1669-1843, 1849-1850, and 1852-1860.

<B34> A nucleic acid encoding the peptide of item <B33>.

<B35> Use of the peptide of item <B33> or <B34> or a nucleic acid encoding said peptide as a diagnostic indicator of colorectal cancer.

<B36> A colorectal cancer specific peptide, comprising a sequence selected from the group consisting of SEQ ID NOs: 1861-1865 and 1867-1909.

<B37> A nucleic acid encoding the peptide of item <B36>.

<B38> Use of the peptide of item <B36> or <B37> or a nucleic acid encoding said peptide as a diagnostic indicator of colorectal cancer.

<B39> A cell population inducing a T cell at a high frequency, T cell line, or recombinantly expressed T cell having the peptide of item <B33>, <B34>, <B36> or <B37> or a nucleic acid sequence encoding said peptide.

<B40> A therapeutic agent for colorectal cancer, comprising the cell population, T cell line, or T cell of item <B39>.

<B41> A method of treating or preventing colorectal cancer by using the cell population, T cell line, or T cell of item <B39>.

<B42> A method of detecting a usage frequency of a V gene by using the method of any one of items <B1>-<B10> or the system of any one of items <B11>-<B20>.

<B43> A method of detecting a usage frequency of a J gene by using the method of any one of items <B1>-<B10> or the system of any one of items <B11>-<B20>.

<B44> A method of detecting a usage frequency of subtype frequency analysis (BCR) by using the method of any one of items <B1>-<B10> or the system of any one of items <B11>-<B20>.

<B45> A method of analyzing a pattern of CDR3 sequence lengths by using the method of any one of items <B1>-<B10> or the system of any one of items <B11>-<B20>.

<B46> A method of analyzing clonality of a TCR or a BCR by using the method of any one of items <B1>-<B10> or the system of any one of items <B11>-<B20>.

<B47> A method of extracting an overlapping read by using the method of any one of items <B1>-<B10> or the system of any one of items <B11>-<B20>.

<B48> A method of searching for a disease specific TCR or BCR clone by using the method of any one of items <B1>-<B10> or the system of any one of <B11>-<B20>.

<B49> A method of analyzing a subject with a diversity index by using the method of any one of items <B1>-<B10> or the system of any one of items <B11>-<B20>.

<B50> A method of assisting analysis on a subject with a diversity index by using the method of any one of items <B1>-<B10> or the system of any one of items <B11>-<B20>.

<B51> The method of item <B49> or <B50>, wherein the diversity index is used as an indicator for measuring a degree of recovery of an immune system after bone marrow transplantation or as an indicator for detecting abnormality in an immune system cell accompanied by hematopoietic tumor.

<B52> The method of item <B49> or <B50>, wherein the diversity index is selected from the group consisting of a Shannon-Wiener's diversity index (H'), Simpson's diversity index ($\lambda$, 1-$\lambda$, or 1/$\lambda$), Pielou's evenness index (J') and Chao1 index.

<B53> A method of analyzing a subject with a similarity index by using the method of any one of items <B1>-<B10> or the system of any one of items <B11>-<B20>.

<B54> A method of assisting analysis on a subject with a similarly index by using the method of any one of items <B1>-<B10> or the system of any one of items <B11>-<B20>.

<B55> The method of item <B53> or <B54>, wherein the similarity index is used as assessment of a degree of similarity of repertoires between matching and mismatching HLA types, or assessment of a degree of similarly of repertoires between a recipient and a donor after bone marrow transplantation.

<B56> The method of item <B53> or <B54>, wherein the similarity index is selected from the group consisting of a Morisita-Horn index, Kimoto's Cπ index, and Pianka's index.

<B57> The method of item <B1>, wherein the (1) comprises the following steps:

(1-1) synthesizing a complementary DNA by using an RNA sample derived from a target cell as a template;

(1-2) synthesizing a double stranded complementary DNA by using the complementary DNA as a template;

(1-3) synthesizing an adaptor-added double stranded complementary DNA by adding a common adaptor primer sequence to the double stranded complementary DNA;

(1-4) performing a first PCR amplification reaction by using the adaptor-added double stranded complementary DNA, a common adaptor primer consisting of the common adaptor primer sequence, and a first TCR or BCR C region specific primer, wherein the first TCR or BCR C region specific primer is designed to comprise a sequence that is sufficiently specific to a C region of interest of the TCR or BCR and not homologous with other genetic sequences, and comprise a mismatching base between subtypes downstream when amplified;

(1-5) performing a second PCR amplification reaction by using a PCR amplicon of (1-4), the common adaptor primer, and a second TCR or BCR C region specific primer, wherein the second TCR or BCR C region specific primer is designed to have a sequence that is a complete match with the TCR or BCR C region in a sequence downstream the sequence of the first TCR or BCR C region specific primer, but comprise a sequence that is not homologous with other genetic sequences, and comprise a mismatching base between subtypes downstream when amplified; and (1-6) performing a third PCR amplification reaction by using a PCR amplicon of (1-5), an added common adaptor primer in which a nucleic acid sequence of the common adaptor primer comprises a first additional adaptor nucleic acid sequence, and an adaptor-added third TCR or BCR C region specific primer in which a second additional adaptor nucleic acid sequence and a molecule identification (MID Tag) sequence are added to a third TCR or BCR C region specific sequence; wherein the third TCR or BCR C region specific primer is designed to have a sequence that is a complete match with the TCR or BCR C region in a sequence downstream to the sequence of the second TCR or BCR C region specific primer, but comprise a sequence that is not homologous with other genetic sequences, and comprise a mismatching base between subtypes downstream when amplified, the first additional adaptor nucleic acid sequence is a sequence suitable for binding to a DNA capturing bead and for an emPCR reaction, the second additional adaptor nucleic acid sequence is a sequence suitable for an emPCR reaction, and the molecule identification (MID Tag) sequence is a sequence for imparting uniqueness such that an amplicon can be identified.

<B58> The system of item <B11>, wherein the (1) kit comprises the following:

(1-1) means for synthesizing a complementary DNA by using an RNA sample derived from a target cell as a template;

(1-2) means for synthesizing a double stranded complementary DNA by using the complementary DNA as a template;

(1-3) means for synthesizing an adaptor-added double stranded complementary DNA by adding a common adaptor primer sequence to the double stranded complementary DNA;

(1-4) means for performing a first PCR amplification reaction by using the adaptor-added double stranded complementary DNA, a common adaptor primer consisting of the common adaptor primer sequence, and a first TCR or BCR C region specific primer, wherein the first TCR or BCR C region specific primer is designed to comprise a sequence that is sufficiently specific to a C region of interest of the TCR or BCR and not homologous with other genetic sequences, and comprise a mismatching base between subtypes downstream when amplified;

(1-5) means for performing a second PCR amplification reaction by using a PCR amplicon of (1-4), the common adaptor primer, and a second TCR or BCR C region specific primer, wherein the second TCR or BCR C region specific primer is designed to have a sequence that is a complete match with the TCR or BCR C region in a sequence downstream the sequence of the first TCR or BCR C region specific primer, but comprise a sequence that is not homologous with other genetic sequences, and comprise a mismatching base between subtypes downstream when amplified; and (1-6) means for performing a third PCR amplification reaction by using a PCR amplicon of (1-5), an added common adaptor primer in which a nucleic acid sequence of the common adaptor primer comprises a first additional adaptor nucleic acid sequence, and an adaptor-added third TCR or BCR C region specific primer in which a second additional adaptor nucleic acid sequence and a molecule identification (MID Tag) sequence are added to a third TCR or BCR C region specific sequence; wherein the third TCR or BCR C region specific primer is designed to have a sequence that is a complete match with the TCR or BCR C region in a sequence downstream to the sequence of the second TCR or BCR C region specific primer, but comprise a sequence that is not homologous with other genetic sequences, and comprise a mismatching base between subtypes downstream when amplified, the first additional adaptor nucleic sequence is a sequence suitable for binding to a DNA capturing bead and for an emPCR reaction, the second additional adaptor nucleic sequence is a sequence suitable for an emPCR reaction, and the molecule identification (MID Tag) sequence is a sequence for imparting uniqueness such that an amplicon can be identified.

<B58-2> The method of item <B57> or the system of item <58>, wherein, for a BCR, the C region specific primer comprises a sequence that is a complete match with an isotype C region of interest selected from the group consisting of IgM, IgA, IgG, IgE and IgD and is not homologous with other C regions, and is a sequence that is a complete match with one of the subtypes IgG1, IgG2, IgG3 and IgG4 or one of IgA1 or IgA2 for IgA or IgG, or, for a TCR, the C region specific primer is a sequence that is a complete match with a C region of a chain of interest selected from the group consisting of α chain, β chain, γ chain and δ chain and is not homologous with other C regions.

<B58-3> The method of item <B57> or <B58-2> or the system of <B58> or <B58-2>, wherein a portion of a sequence that is a complete match with all C region allelic sequences of the same isotype in the database is selected for the C region specific primer.

<B58-4> The method of any one of items <B57> and <B58-2>-<B58-3> or the system of any one of <B58>-<B58-3>, wherein the common adaptor primer is designed such that the primer is unlikely to have homodimer and intramolecular hairpin structures and can stably form a double strand, and designed not to be highly homologous with all TCR genetic sequences in the database and to have the same level of melting temperature (Tm) as the C region specific primer.

<B58-5> The method of any one of items <B57> and <B58-2>-<B58-4> or the system of any one of <B58>-<B58-4>, wherein the common adaptor primer designed not to have homodimer and intramolecular hairpin structures and to have homology with other genes comprising a BCR or TCR is selected.

<B58-6> The method of any one of items <B57> and <B58-2>-<B58-5> or the system of any one of <B58>-<B58-5>, wherein the common adaptor primer is P20EA (SEQ ID NO: 2) and/or P10EA (SEQ ID NO: 3).

<B58-7> The method of any one of items <B57> and <B58-2>-<B58-6> or the system of any one of <B58>-<B58-6>, wherein the first, second and third TCR or BCR C region specific primers are each independently a primer for BCR repertoire analysis, the primer being selected to be a sequence that is a complete match with each isotype C region of IgM, IgG, IgA, IgD or IgE, and a complete match with subtypes for IgG and IgA, and not homologous with other sequences comprised in the database, and comprise a mismatching base between subtypes downstream of the primer, and wherein the common adaptor primer sequence is designed such that the sequence has a base length suitable for amplification, is unlikely to have homodimer and intramolecular hairpin structures, and is able to stably form a double strand, and designed not to be highly homologous with all TCR genetic sequences in the database and to have the same level of Tm as the C region specific primer.

<B58-8> The method of any one of items <B57> and <B58-2>-<B58-7> or the system of any one of <B58>-<B58-7>, wherein the first, second and third TCR or BCR C region specific primers are each independently a primer for TCR or BCR repertoire analysis, each primer being selected to be a sequence that is a complete match with 1 type of α chain (TRAC), 2 types of β chains (TRBCO1 and TRBCO2), 2 types of γ chains (TRGC1 and TRGC2), and one type of δ chain (TRDC1) and is not homologous with other sequences comprised in the database, and comprise a mismatching base between subtypes downstream of the primer, wherein the common adaptor primer sequence is designed such that the sequence has a base length suitable for amplification, is unlikely to have homodimer and intramolecular hairpin structures, and is able to stably form a double strand, and designed not to be highly homologous with all TCR genetic sequences in the database and to have the same level of Tm as the C region specific primer.

<B58-9> The method of any one of items <B57> and <B58-2>-<B58-8> or the system of any one of <B58>-<B58-8>, wherein the third TCR or BCR C region specific primer is set in a region that is up to about 150 bases from the 5' terminal side of a C region, and the first TCR or BCR C region specific primer and the second TCR or BCR C region specific primer are set between the 5' terminal side of a C region to about 300 bases.

<B58-10> The method of any one of items <B57> and <B58-2>-<B58-9> or the system of any one of <B58>-<B58-9>, wherein the first, second and third TCR or BCR C region specific primers are each independently for BCR quantitative analysis, wherein separate specific primers are set to 5 types of isotype sequences, and the primers are designed to completely match a target sequence and ensure a mismatch of 5 bases or more for other isotypes and are designed to be a complete match with all subtypes such that one type of primer is compatible with each similar IgG subtype (IgG1, IgG2, IgG3 and IgG4) or IgA subtype (IgA1 and IgA2).

<B58-11> The method of any one of items <B57> and <B58-2>-<358-10> or the system of any one of <358>-<B58-10>, wherein parameters in primer design are set to: a base sequence length of 18-22 bases; a melting temperature of 54-66° C.; and % GC (% guanine-cytosine content) of 40-65%.

<B58-12> The method of any one of items <B57> and <B58-2>-<B58-11> or the system of any one of <B58>-<B58-11>, wherein parameters in primer design are set to: a base sequence length of 18-22 bases; a melting temperature of 54-66° C.; and % GC (% guanine-cytosine content) of 40-65%; a self-annealing score of 26; a self-end annealing score of 10; and a secondary structure score of 28.

<B58-13> The method of any one of items <B57> and <B58-2>-<B58-12> or the system of any one of <B58>-<B58-12>, wherein sequences of the first, second and third TCR or BCR C region specific primers are determined under the following conditions:

1. a plurality of subtype sequences and/or allelic sequences are uploaded into a base sequence analysis software and aligned;
2. a primer designing software is used to search for a plurality of primers satisfying a parametric condition in a C region;
3. a primer in a region without a mismatching base in the aligned sequences in 1 is selected; and
4. the presence of a plurality of mismatching sequences for each subtype and/or allele downstream of the primer determined in 3 is confirmed, and if there is no such sequence, a primer is searched further upstream, which is further repeated as needed.

<B58-14> The method of any one of items <B57> and <B58-2>-<B58-13> or the system of any one of <B58>-<B58-13>, wherein the first TCR or BCR C region specific primer is set in a position at bases 41-300 with a first base of a first codon of a C region sequence produced by splicing as a baseline, the second TCR or BCR C region specific primer is set in a position at bases 21-300 with said first base as the baseline, and the third TCR or BCR C region specific primer is set in a position within 150 bases or less with said first base as the baseline, and the positions comprise a mismatching site in a subtype and/or allele.

<B58-15> The method of any one of items <B57> and <B58-2>-<B58-14> or the system of any one of <B58>-<B58-14>, wherein the first TCR or BCR C region specific primer has the following structure: CM1 (SEQ ID NO: 5), CA1 (SEQ ID NO: 8), CG1 (SEQ ID NO: 11), CD1 (SEQ ID NO: 14), CE1 (SEQ ID NO: 17), CA1 (SEQ ID NO: 35) or CB1 (SEQ ID NO: 37).

<B58-16> The method of any one of items <B57> and <858-2>-<B58-15> or the system of any one of <B58>-<B58-15>, wherein the second TCR or BCR C region specific primer has the following structure: CM2 (SEQ ID NO: 6), CA2 (SEQ ID NO: 9), CG2 (SEQ ID NO: 12), CD2 (SEQ ID NO: 15), CE2 (SEQ ID NO: 18), CA2 (SEQ ID NO: 35), or CB2 (SEQ ID NO: 37).

<B58-17> The method of any one of items <B57> and <B58-2>-<B58-16> or the system of any one of <B58>-<B58-16>, wherein the third TCR or BCR C region specific primer has the following structure: CM3-GS (SEQ ID NO: 7), CA3-GS (SEQ ID NO: 10), CG3-GS (SEQ ID NO: 13), CD3-GS (SEQ ID NO: 16) or CE3-GS (SEQ ID NO: 19).

<B58-18> The method of any one of items <B57> and <B58-2>-<B58-17> or the system of any one of <B58>-<B58-17>, wherein each of the TCR or BCR C region specific primers is provided in a set compatible with all TCR or BCR subclasses.

<B58-19> A method or system of performing gene analysis using a sample manufactured by the method of any one of items <B57> and <B58-2>-<B58-18> or the system of any one of <B58>-<B58-18>.

<B58-20> The method or system of item <B58-19>, wherein the gene analysis is the quantitative analysis of a repertoire of a variable region of a T cell receptor (TCR) or a B cell receptor (BCR).

<B59> The method of any one of items <B57> and <B58-2>-<B58-20> or the system of any one of <B58>-<B58-20>, wherein (3) derivation of the TCR or BCR repertoire is accomplished by a method comprising the following steps:
(3-1) providing a reference database for each gene region comprising at least one of a V region, a D region, a J region and optionally a C region;

(3-2) providing an input sequence set which is optionally trimmed and optionally extracted to have a suitable length;
(3-3) searching for homology of the input sequence set with the reference database for the each gene region and recording an alignment with an approximate reference allele and/or a sequence of the reference allele;
(3-4) assigning the V region and the J region for the input sequence set and extracting a nucleic acid sequence of the D region based on a result of assigning;
(3-5) translating the nucleic acid sequence of the D region into an amino acid sequence and classifying the D region by utilizing the amino acid sequence; and
(3-6) calculating a frequency of appearance for each of the V region, the D region, and the J region and optionally the C region or a frequency of appearance of a combination thereof based on the classifying in (3-5) to derive the TCR or BCR repertoire.

<B60> The system of any one of items <B11>-<B20>, and <B58>-<B58-20> and <B59>, wherein (3) an apparatus for deriving the TCR or BCR repertoire comprises the following:
(3-1) means for providing a reference database for each gene region comprising at least one of a V region, a D region, a J region and optionally a C region;
(3-2) means for providing an input sequence set which is optionally trimmed and optionally extracted to have a suitable length;
(3-3) means for searching for homology of the input sequence set with the reference database for the each gene region and recording an alignment with an approximate reference allele and/or a sequence of the reference allele;
(3-4) means for assigning the V region and the J region for the input sequence set and extracting a nucleic acid sequence of the D region based on a result of assigning;
(3-5) means for translating the nucleic acid sequence of the D region into an amino acid sequence and classifying the D region by utilizing the amino acid sequence; and
(3-6) means for calculating a frequency of appearance for each of the V region, the D region, and the J region and optionally the C region or a frequency of appearance of a combination thereof based on the classifying in (3-5) to derive the TCR or BCR repertoire.

<B60-2> The method of any one of items <B57>, <B58-2>-<B58-20>, and <B59> or the system of any one of <B58>-<B58-20>, <B59> and <B60>, wherein the gene region comprises all of the V region, the D region, the J region and optionally the C region.

<B60-3> The method of any one of items <B57>, <B58-2>-<B58-20>, <B59>, and <B60-2> or the system of any one of <B58>-<B58-20>, <B59> and <B60>-<B60-2>, wherein the reference database is a database with a unique ID assigned to each sequence.

<B60-4> The method of any one of items <B57>, <B58-2>-<B58-20>, <B59>, and <B60-2>-<B60-3> or the system of any one of <B58>-<B58-20>, <B59> and <B60>-<B60-3>, wherein the input sequence set is an unbiased sequence set.

<B60-5> The method of any one of items <B57>, <B58-2>-<B58-20>, <B59>, and <B60-2>-<B60-4> or the system of any one of <B58>-<B58-20>, <B59> and <B60>-<B60-4>, wherein the sequence set is trimmed.

<B60-6> The method of any one of items <B57>, <B58-2>-<B58-20>, <B59>, and <B60-2>-<B60-5> or the system of any one of <B58>-<B58-20>, <B59> and <B60>-<B60-5>, wherein the trimming is accomplished by the steps of: deleting low quality regions from both ends of a read; deleting a region matching 10 bp or more with an adaptor sequence from the both ends of the read; and using the read as a high quality read in analysis when a remaining length is 200 bp or more (TCR) or 300 bp or more (BCR).

<B60-7> The method of any one of items <B57>, <B58-2>-<B58-20>, <B59>, and <B60-2>-<B60-6> or the system of any one of <B58>-<B58-20>, <B59> and <B60>-<B60-6>, wherein the low quality refers to a 7 bp moving average of QV value less than 30.

<B60-8> The method of any one of items <B57>, <B58-2>-<B58-20>, <B59>, and <B60-2>-<B60-7> or the system of any one of <B58>-<B58-20>, <B59> and <B60>-<B60-7>, wherein the approximate sequence is the closest sequence.

<B60-9> The method of any one of items <B57>, <B58-2>-<B58-20>, <B59>, and <B60-2>-<B60-8> or the system of any one of <B58>-<B58-20>, <B59> and <B60>-<B60-8>, wherein the approximate sequence is determined by a ranking of 1. number of matching bases, 2. kernel length, 3. score, and 4. alignment length.

<B60-10> The method of any one of items <B57>, <B58-2>-<B58-20>, <B59>, and <B60-2>-<B60-9> or the system of any one of <B58>-<B58-20>, <B59> and <B60>-<B60-9>, wherein the homology search is conducted under a condition tolerating random mutations to be scattered throughout.

<B60-11> The method of any one of items <B57>, <B58-2>-<B58-20>, <B59>, and <B60-2>-<B60-10> or the system of any one of <B58>-<B58-20>, <B59> and <B60>-<B60-10>, wherein the homology search comprises at least one condition from (1) shortening of a window size, (2) reduction in a mismatch penalty, (3) reduction in a gap penalty, and (4) a top priority ranking of an indicator is a number of matching bases, compared to a default condition.

<B60-12> The method of any one of items <B57>, <B58-2>-<B58-20>, <B59>, and <B60-2>-<B60-11> or the system of any one of <B58>-<B58-20>, <B59> and <B60>-<B60-11>, wherein the homology search is carried out under the following conditions in BLAST or FASTA:
  V mismatch penalty=−1, shortest alignment length=30, and shortest kernel length=15;
  D word length=7 (for BLAST) or K-tup=3 (for FASTA), mismatch penalty=−1, gap penalty=0, shortest alignment length=11, and shortest kernel length=8;
  J mismatch penalty=−1, shortest hit length=18, and shortest kernel length=10; and
  C shortest hit length=30 and shortest kernel length=15.

<B60-13> The method of any one of items <B57>, <B58-2>-<B58-20>, <B59>, and <B60-2>-<B60-12> or the system of any one of <B58>-<B58-20>, <B59> and <B60>-<B60-12>, wherein the D region is classified by a frequency of appearance of the amino acid sequence.

<B60-14> The method of any one of items <B57>, <B58-2>-<B58-20>, <B59>, and <B60-2>-<B60-13> or the system of any one of <B58>-<B58-20>, <B59> and <B60>-<B60-13>, wherein a combination of a result of search for homology with the nucleic acid sequence of CDR3 and a result of amino acid sequence translation is used as a classification result when there is a reference database for the D region in the step (5).

<B60-15> The method of any one of items <B57>, <B58-2>-<B58-20>, <B59>, and <B60-2>-<B60-14> or the system of any one of <B58>-<B58-20>, <B59> and <B60>-<B60-14>, wherein only the frequency of appearance of the amino acid sequence is used for classification when there is no reference database for the D region in the step (5).

<B60-16> The method of any one of items <B57>, <B58-2>-<B58-20>, <B59>, and <B60-2>-<B60-15> or the system of any one of <B58>-<B58-20>, <B59> and <B60>-<B60-15>, wherein the frequency of appearance is counted in a unit of a gene name and/or a unit of an allele
<B60-17> The method of any one of items <B57>, <B58-2>-<B58-20>, <B59>, and <B60-2>-<B60-16> or the system of any one of <B58>-<B58-20>, <B59> and <B60>-<B60-16>, wherein the step (4) comprises the step of assigning the V region and the J region for the input sequence set and extracting a CDR3 sequence, with the front of CDR3 on a reference V region and end of CDR3 on reference J as guides.
<B60-18> The method of any one of items <B57>, <B58-2>-<B58-20>, <B59>, and <B60-2>-<B60-17> or the system of any one of <B58>-<B58-20>, <B59> and <B60>-<B60-17>, wherein the step (5) comprises translating the nucleic acid sequence of the CDR3 into an amino acid sequence and classifying a D region by using the amino acid sequence.
<B60-19> The system of any one of items <B11>-<B20>, <B58>-<B58-20>, <B59> and <B60>-<B60-18>, wherein
(3) an apparatus for deriving the TCR or BCR repertoire comprises:
(3-1) means for providing a reference database for each gene region comprising at least one of a V region, a D region, a J region and optionally a C region;
(3-2) means for providing an input sequence set which is optionally trimmed and optionally extracted to have a suitable length;
(3-3) means for searching for homology of the input sequence set with the reference database for the each gene region and recording an alignment with an approximate reference allele and/or a sequence of the reference allele;
(3-4) means for assigning the V region and the J region for the input sequence set and extracting a nucleic acid sequence of the D region based on a result of assigning;
(3-5) means for translating the nucleic acid sequence of the D region into an amino acid sequence and classifying the D region by utilizing the amino acid sequence; and
(3-6) means for calculating a frequency of appearance for each of the V region, the D region, and the J region and optionally the C region or a frequency of appearance of a combination thereof in the input sequence set to derive the TCR or BCR repertoire.
<B60-20> The system of any one of items <B11>-<B20>, <B58>-<B58-20>, <B59> and <B60>-<B60-19>, wherein processing of a method of analyzing the TCR or BCR repertoire is materialized by a computer program for having a computer execute the processing comprising the following steps:
(1) providing a reference database for each gene region comprising at least one of a V region, a D region, a J region and optionally a C region;
(2) providing an input sequence set which is optionally trimmed and optionally extracted to have a suitable length;
(3) searching for homology of the input sequence set with the reference database for the each gene region and recording an alignment with an approximate reference allele and/or a sequence of the reference allele;
(4) assigning the V region and the J region for the input sequence set and extracting a nucleic acid sequence of the D region based on a result of assigning;
(5) translating the nucleic acid sequence of the D region into an amino acid sequence and classifying the D region by utilizing the amino acid sequence; and
(6) calculating a frequency of appearance for each of the V region, the D region, and the J region and optionally the C region or a frequency of appearance of a combination thereof in the input sequence set to derive the TCR or BCR repertoire.
<B60-21> The system of any one of items <B11>-<B20>, <B58>-<B58-20>, <B59> and <B60>-<B60-20> for having a computer execute processing of a method of analyzing a TCR or BCR repertoire, the method comprising the following steps:
(1) providing a reference database for each gene region comprising at least one of a V region, a D region, a J region and optionally a C region;
(2) providing an input sequence set which is optionally trimmed and optionally extracted to have a suitable length;
(3) searching for homology of the input sequence set with the reference database for the each gene region and recording an alignment with an approximate reference allele and/or a sequence of the reference allele;
(4) assigning the V region and the J region for the input sequence set and extracting a nucleic acid sequence of the D region based on a result of assigning;
(5) translating the nucleic acid sequence of the D region into an amino acid sequence and classifying the D region by utilizing the amino acid sequence; and
(6) calculating a frequency of appearance for each of the V region, the D region, and the J region and optionally the C region or a frequency of appearance of a combination thereof in the input sequence set to derive the TCR or BCR repertoire.

<Examples of Application in Analysis>
<C1>
A method of applying a cancer idiotype peptide sensitization immune cell therapeutic method to a subject, the method comprising:
(1) analyzing a T cell receptor (TCR) or B cell receptor (BCR) repertoire of the subject by the method of any one of items <B1>-<B10>, <B57>, <B58-2>-<B58-20>, <B59>, and <B60>-<B60-21> or the system of any one of items <B11>-<B20>, <B58>-<B58-20>, <B59> and <B60>-<B60-21>;
(2) determining a TCR or BCR derived from a cancer cell of the subject based on a result of the analysis, wherein the determining is done by selecting a high ranking sequence in a frequency of presence ranking of a TCR or BCR gene derived from the cancer cell of the subject as the TCR or BCR derived from the cancer cell;
(3) determining an amino acid sequence of a candidate HLA test peptide based on the determined TCR or BCR derived from cancer, wherein the determining is performed based on a score calculated by using an HLA binding peptide prediction algorithm;
(4) synthesizing the determined peptide; and optionally
(5) administering therapy by using the synthesized peptide.
<C2>
The method of item <C1>, wherein the candidate HLA test peptide of the step (3) is determined by using BIMAS, SYFPEITHI, RANKPEP or NetMHC.
<C3> <Improved CTL Method>
The method of item <C1> or <C2>, wherein the method comprises, after the step (4), the steps of: mixing the peptide, an antigen presenting cell or a dendritic cell derived from the subject, and a CD8$^+$ T cell derived from the subject and culturing the mixture; and administering the mixture after culturing to a patient.
<C4> DC Vaccination Therapeutic Method
The method of any one of items <C1>-<C3> comprising, after the step (4), the steps of: mixing the peptide with the dendritic cell derived from the subject and culturing the mixture; and administering the cultured mixture to a patient.
<C5> <Patient Autoimmune Cell Therapeutic Method>

The method of any one of items <C1>-<C4>, wherein the method comprises, after the step (4), the steps of: mixing the peptide, the antigen presenting cell or the dendritic cell derived from the subject and a CD8+ T cell derived from the subject and culturing the mixture to produce a CD8+ T cell-dendritic cell/antigen presenting cell-peptide mixture; mixing the peptide with the dendritic cell derived from the subject and culturing the mixture to produce a dendritic cell-peptide mixture; and administering the CD8+ T cell-dendritic cell/antigen presenting cell-peptide mixture and the dendritic cell-peptide mixture to a patient.

<D1> <Isolation of Tailor-Made Cancer Specific T Cell> Receptor Gene, Isolation of Cancer Specific TCR Gene by In Vitro Antigen Stimulation A method of isolating a cancer specific TCR gene by an in vitro antigen stimulation, comprising:
(A) mixing an antigen peptide or antigen protein derived from a subject or the determined peptide of any one of items <C1>-<C5> or a lymphocyte derived from the subject, an inactivated cancer cell derived from the subject, and a T lymphocyte derived from the subject and culturing the mixture to produce a tumor specific T cell;
(B) analyzing a TCR of the tumor specific T cell by the method of any one of items <B1>-<B10>, <B57>, <B58>-<B58-20>, <B59>, and <B60>-<B60-21> and/or the system of any one of items <B11>-<B20>, <B58>-<B58-20>, <B59> and <B60>-<B60-21>; and
(C) isolating a desired tumor specific T cell based on a result of the analyzing.
<D1-1>

The method of item <D1>, wherein step (A) is a step of mixing the inactivated cancer cell derived from the subject and the antigen peptide or antigen protein derived from the subject with the T lymphocyte derived from the subject and culturing the mixture to produce a tumor specific T cell.
<D1-2>

The method of any one of items <D1>-<D1-1>, wherein the step (A) is a step of mixing the lymphocyte derived from the subject, the inactivated cancer cell derived from the subject, and the T lymphocyte derived from the subject and culturing the mixture to produce a tumor specific T cell.
<D1-3>

The method of any one of items <D1>-<D1-2>, wherein the step (A) is a step of mixing the determined peptide of item C1, the inactivated cancer cell derived from the subject, and the T lymphocyte derived from the subject and culturing the mixture to produce a tumor specific T cell.

<D2> <Isolation of Tailor-Made Cancer Specific T Cell Receptor> Gene, Isolation of Cancer Specific TCR Gene by Searching for a Common Sequence A method of isolating a cancer specific TCR gene by searching for a common sequence, comprising:
(A) isolating a lymphocyte or cancer tissue from subjects having a common HLA;
(B) analyzing a TCR of the tumor specific T cell by the method of item B1 for the lymphocyte or cancer tissue; and
(C) isolating a T cell having a sequence in common with the tumor specific T cell.

<E1> <CPC>

A cell processing therapeutic method, comprising:
A) collecting a T lymphocyte from a patient;
B) analyzing TCRs based on the method of any one of items <B1>-<B10>, <B57>, <B58>-<B58-20>, <B59>, and <B60>-<B60-21> and/or the system of any one of items <B11>-<B20>, <B58>-<B58-20>, <B59> and <B60>-<B60-21> after applying antigen stimulation to the T lymphocyte, wherein the antigen stimulation is applied by an antigen peptide or antigen protein derived from the subject, an inactivated cancer cell derived from the subject, or an idiotype peptide derived from tumor;
C) selecting an optimal TCR and an optimal antigen in the analyzed TCRs;
D) producing a tumor specific α and β TCR expression viral vector of a TCR gene of the optimal TCR; and
E) introducing the T lymphocyte introduced with a tumor specific TCR gene into the patient.
<E1-1>

The cell processing therapeutic method of item <E1>, wherein the antigen stimulation is applied with the antigen peptide or antigen protein derived from the subject.
<E1-2>

The cell processing therapeutic method of item <E1> or <E1-1>, wherein the antigen stimulation is applied with the inactivated cancer cell derived from the subject.
<E1-3>

The cell processing therapeutic method of any one of items <E1> and <E1-1>-<E1-2>, wherein the antigen, stimulation is applied with the idiotype peptide derived from tumor.
<E1-4>

The method of any one of items <E1> and <E1-1>-<E1-3>, wherein the step C) comprises selecting an antigen that is highly expressed in cancer tissue of the subject.
<E1-5>

The method of any one of items <E1> and <E1-1>-<E1-4>, wherein the step C) comprises selecting an antigen which most strongly activates a T cell in an antigen specific lymphocyte stimulation test.
<E1-6>

The method of any one of items <E1> and <E1-1>-<E1-5>, wherein the step C) comprises selecting an antigen that increases a frequency of a specific TCR the most from repertoire analysis conducted based on the method of any one of items <B1>-<B10>, <B57>, <B58>-<B58-20>, <B59>, and <B60>-<B60-21> and/or the system of any one of items <B11>-<B20>, <B58>-<B58-20>, <B59> and <B60>-<B60-21> before and after applying the antigen stimulation.

<E2> <RAC of CPC>

A method of assessing efficacy and/or safety by a stimulation test in vitro by using a cancer specific TCR gene isolated by the method of item <D2>.

<CC1>

A method of preparing a composition for use in a cancer idiotype peptide sensitization immune cell therapeutic method to a subject, the method comprising:
(1) analyzing a T cell receptor (TCR) or B cell receptor (BCR) repertoire of the subject by the method of any one of items <B1>-<B10>, <B57>, <B58>-<B58-20>, <B59>, and <B60>-<B60-21> and/or the system of any one of items <B11>-<B20>, <B58>-<B58-20>, <B59> and <B60>-<B60-21>;
(2) determining a TCR or BCR derived from a cancer cell of the subject based on a result of the analysis, wherein the determining is done by selecting a high ranking sequence in a frequency of presence ranking of a TCR or BCR gene derived from the cancer cell of the subject as the TCR or BCR derived from the cancer cell;
(3) determining an amino acid sequence of a candidate HLA test peptide based on the determined TCR or BCR derived from cancer, wherein the determining is performed based on a score calculated by using an HLA binding peptide prediction algorithm; and (4) synthesizing the determined peptide.

<CC2>

The method of item <CC1>, wherein the candidate HLA test peptide of the step (3) is determined by using BIMAS, SYFPEITHI, RANKPEP or NetMHC.

<CC3> <Improved CTL Method≥

The method of item <CC1> or <CC2>, wherein the method comprises, after the step (4), the step of: mixing the peptide, an antigen presenting cell or a dendritic cell derived from the subject, and a CD8$^+$ T cell derived from the subject and culturing the mixture.

<CC4> <DC Vaccination Therapeutic Method≥

The method of any one of items <CC1>-<CC2> comprising, after the step (4), the step of: mixing the peptide with a dendritic cell derived from the subject and culturing the mixture.

<CC5> <Patient Autoimmune Cell Therapeutic Method>

The method of any one of items <CC1>-<CC4>, wherein the method comprises, after the step (4), the steps of: mixing the peptide, the antigen presenting cell or the dendritic cell derived from the subject and a CD8$^+$ T cell derived from the subject and culturing the mixture to produce a CD8$^+$ T cell-dendritic cell/antigen presenting cell-peptide mixture; and mixing the peptide with the dendritic cell derived from the subject and culturing the mixture to produce a dendritic cell-peptide mixture.

<DD1> <Isolation of Tailor-Made Cancer Specific T Cell> Receptor Gene, Isolation of Cancer Specific TCR Gene by In Vitro Antigen Stimulation A method of preparing an isolated cancer specific TCR gene by an in vitro antigen stimulation, comprising:

(A) mixing an antigen peptide or antigen protein derived from a subject or the determined peptide of any one of items <CC1>-<CC5> or a lymphocyte derived from the subject, an inactivated cancer cell derived from the subject, and a T lymphocyte derived from the subject and culturing the mixture to produce a tumor specific T cell;

(B) analyzing a TCR of the tumor specific T cell by the method of any one of items <B1>-<B10>, <B57>, <B58>-<B58-20>, <B59>, and <B60>-<B60-21> and/or the system of any one of items <B11>-<B20>, <B58>-<B58-20>, <B59> and <B60>-<B60-21>; and (CC) isolating a desired tumor specific T cell based on a result of the analyzing.

<DD1-1>

The method of item <DD1>, wherein the step (A) is a step of mixing the inactivated cancer cell derived from the subject and the antigen peptide or antigen protein derived from the subject with the T lymphocyte derived from the subject and culturing the mixture to produce a tumor specific T cell.

<DD1-2>

The method of item <DD1> or <DD1-1>, wherein the step (A) is a step of mixing the lymphocyte derived from the subject, the inactivated cancer cell derived from the subject, and the T lymphocyte derived from the subject and culturing the mixture to produce a tumor specific T cell.

<DD1-3>

The method of any one of items <DD1>-<DD1-2>, wherein the step (A) is a step of mixing the determined peptide of item CC1, the inactivated cancer cell derived from the subject, and the T lymphocyte derived from the subject and culturing the mixture to produce a tumor specific T cell.

<DD2> <Isolation of Tailor-Made Cancer Specific T Cell Receptor Gene, Isolation of Cancer Specific TCR Gene by Searching for a Common Sequence>

A method of preparing an isolated cancer specific TCR gene by searching for a common sequence, comprising:

(A) providing a lymphocyte or cancer tissue isolated from subjects having a common HLA;

(B) analyzing a TCR of the tumor specific T cell by the method of any one of items <B1>-<B10>, <B57>, <B58>-<B58-20>, <B59>, and <B60>-<B60-21> and/or the system of any one of items <B11>-<B20>, <B58>-<B58-20>, <B59> and <B60>-<B60-21> for the lymphocyte or cancer tissue; and (C) isolating a T cell having a sequence in common with the tumor specific T cell.

<EE1> <CCPCC>

A method of preparing a T lymphocyte introduced with a tumor specific TCR gene for use in a cell processing therapeutic method, comprising:

A) providing a T lymphocyte collected from a patient;

B) analyzing TCCRs based on the method of any one of items <B1>-<B10>, <B57>, <B58>-<B58-20>, <B59>, and <B60>-<B60-21> and/or the system of any one of items <B11>-<B20>, <B58>-<B58-20>, <B59> and <B60>-<B60-21> after applying an antigen stimulation to the T lymphocyte, wherein the antigen stimulation is applied by an antigen peptide or antigen protein derived from the subject, an inactivated cancer cell derived from the subject, or an idiotype peptide derived from tumor;

CC) selecting an optimal TCR and an optimal antigen in the analyzed TCRs; and

DD) producing a tumor specific α and β TCR expression viral vector of a TCCR gene of the optimal TCR.

<EE1-1>

The method of item <EE1>, wherein the antigen stimulation is applied with the antigen peptide or antigen protein derived from the subject.

<EE1-2>

The method of item <EE1> or <EE1-1>, wherein the antigen stimulation is applied with the inactivated cancer cell derived from the subject.

<EE1-3>

The method of any one of items <EE1>-<EE1-2>, wherein the antigen stimulation is applied with the idiotype peptide derived from tumor.

<EE1-4>

The method of any one of items <EE1>-<EE1-3>, wherein the step C) comprises selecting an antigen that is highly expressed in cancer tissue of the subject.

<EE1-5>

The method of any one of items <EE1>-<EE1-4>, wherein the step C) comprises selecting an antigen which most strongly activates a T cell in an antigen specific lymphocyte stimulation test.

<EE1-6>

The method of any one of items <EE1>-<EE1-5>, wherein the step C) comprises selecting an antigen that increases a frequency of a specific TCCR the most from repertoire analysis conducted based on item <B1> before and after applying the antigen stimulation.

<EE2> <RACC of CCPCC>

A method of assessing efficacy and/or safety by a stimulation test in vitro by using a cancer specific TCCR gene isolated by the method of item <DD2>.

The specific steps of the efficacy and/or safety assessment is exemplified below.

<Efficacy> For instance, efficacy can be assessed, after culturing a T cell introduced with a cancer specific TCR gene with the antigen peptide or antigen protein derived from the subject of <EE1-1>, inactivated cancer cell derived from the subject of <EE1-2>, or idiotype peptide derived from tumor of <EE1-3>, by measuring the amount of cytokines (interferon γ or the like) secreted to the outside of a cell in response to T cell activation, by measuring the amount of expression of a specific gene that is elevated in response to T cell activation, or by measuring a cell surface molecule that is expressed or undergoes increased expression in response to T cell activation.

<Safety> For instance, safety can be assessed, when a T cell derived from the subject introduced with a cancer specific TCR gene is mixed with a normal cell derived from the subject, by measuring the above-described cytokines secreted, gene expression, or expression of a cell surface molecule in response to T cell activation and confirming that the T cell transgenically introduced with a TCR is not activated by a normal cell.

It is understood that the present invention can further be provided as a combination of one or more of the aforementioned features in addition to the explicitly shown combinations. Further embodiments and advantages of the present invention are recognized by those skilled in the art by reading and understanding the following Detailed Description as needed.

Advantageous Effects of Invention

The present invention has an effect of being capable of handling a "large scale" sequence relative to conventional techniques. The present invention is considered to have an especially advantageous effect in terms of being able to, regardless of a mutation, amplify in an "unbiased" manner and make an accurate determination for especially BCRs, as numerous mutations are observed. The present invention is considered 1. unbiased, and 2. therefore has excellent quantifiability with respect to amplification methods and sequencing methods utilizing a V chain specific primer among conventional systems. The present invention is also advantageous with respect to techniques such as SMART PCR in terms of 1. significantly improved "level of unbiasedness" and 2. lack of the unique disadvantages of each technique. For instance, an issue of Repeated Template Switching is reported for SMART. However, the present system does not have such an issue. Further, other advantageous effects include 3. the capability of comprehensive analysis, including identification of isotypes and subtypes.

The system and method of the present invention can derive TCR and BCR repertoires of α, β, γ, and δ chains for TCRs and IgM, IgD, IgA, IgG, and IgE heavy chains and IgK and IgL light chains for BCRs and detect a change in the repertoires from various aspects. A C region primer for a sequence is arranged at a suitable position in order to accurately determine a CDR3 region base sequence that is important in identifying a disease specific TCR or BCR. Furthermore, a primer position is devised such that the type of isotype or subtype can be identified and a gene associated with a disease is readily identified.

All conventional techniques employed A plurality of PCR using numerous V chain specific primers and had a significant issue in quantification or precision. However, such an issue was resolved. Further, use of the analysis system of the present invention also accomplishes the following. For instance, the analysis system can screen for invariant TCRs. It was discovered that invariant TCRs can be screened because a read overlapping in numerous samples is searched regardless of HLA in a TCRα chain in TCR repertoire analysis for a large scale base sequence. In fact, it was possible to detect numerous TCRs derived from MAIT recognizing MR1, which is a non-classical MHC. It is known that NKT, MAIT or the like expressing an invariant TCR serves an important role in immune responses such as infection immunity, antitumor or inflammation. It is expected that a novel invariant TCR can be screened for in various tissue samples and utilized to find a cell with a unique function.

Furthermore, a TCRα and TCRβ gene pair of an antigen specific TCR can be estimated. TCRα and TCRβ are receptor molecules forming a heterodimer. An antigen specific T cell that proliferates in response to an antigen consists of specific unique TCRα and TCRβ chains. However, since TCR repertoire analysis amplifies TCRα and TCRβ genes separately, it is not possible to known which TCRα and which TCRβ form a pair. In this regard, it is possible to estimate paired TCRα and TCRβ chain genes by examining whether a combination of individuals with an overlap in a specific TCRβ chain read matches with individuals with an overlap in a TCRα chain (FIG. 44). It was possible to estimate a matching TCRα chain by using individuals with an overlap in a specific TCRβ chain as an indicator (Table 3-11). Although there are cases where this is assigned to a plurality of reads, it is considered to be a searching method that is useful in identifying paired TCR genes.

It is especially useful in clinical applications where a sample for highly precise, unbiased, large scale gene analysis is provided and quantitative analysis is especially required. Further, the present invention can identify a "low frequency" ($1/10{,}000$-$1/100{,}000$ or lower) gene, leading to a more accurate diagnosis or therapy of leukemia or the like. This was not possible with conventional techniques (method of combining plating with an adaptor or method of combining plating with the SMART method) due to the detection limit (about 1%).

Further, a V specific technology has low quantifiability due to varying amplification efficiency among V specific primers. However, this technology performs amplification with one set of primers, thus enabling highly precise quantification in the truest sense.

Further, since all TCRs or BCRs can be amplified with one set of primers, primers and containers required for amplification can be reduced to cut expenses.

Further, BCRs are characterized by having a mutation. Thus, a method using a V chain specific primer has disadvantages such as essentially being unable to perform amplification, or producing a gene with reduced amplification efficiency or the like. Meanwhile, the method of the present invention can also solve problems in BCRs.

Further, the analysis method using the present invention is advantageous in that it can complete the method in several minutes while conventional techniques complete overnight.

<Wet Associated Effect>

The present invention is especially useful in clinical applications where quantitative analysis is especially required and a sample is provided for highly precise, unbiased, large scale gene analysis. Further, the Present Invention can Identify a "Low Frequency" ($1/10000$-$1/100000$ or Lower) Gene, Leading to a More Accurate diagnosis or therapy of leukemia or the like. This was not possible with conventional techniques (method of combining plating with an adaptor or method of combining plating with the SMART method) due to the detection limit (about 1%).

Further, a V specific technology has low quantifiability due to varying amplification efficiency among V specific primers. However, this technology performs amplification with one set of primers, thus enabling highly precise quantification in the truest sense.

Further, since all TCRs or BCRs can be amplified with one set of primers, primers and containers required for amplification can be reduced to cut expenses.

Further, BCRs are characterized by having a mutation. Thus, a method using a V chain specific primer has disadvantages such as essentially being unable to perform amplification, or producing a gene with reduced amplification efficiency or the like. Meanwhile, the method of the present invention can also solve problems in BCRs.

Further, the analysis method using the present invention is advantageous in that it can complete the method in several minutes while conventional techniques complete overnight.

<In Silico Associated Effect>

Significant differences from conventional and commonly used IMGT/High-V-QUEST include the following: IMGT/High-V-QUEST does not have a function for classifying a C region, and repertoire classification is either "unit of gene name" or "unit of allele" (i.e., (*) V (gene name)-D (gene name)-J (gene name) or V (allele)-D (allele)-J (allele)). Further, CDR3 classification is possible when performed separately from the above-described repertoire, but has no degree of freedom. On the other hand, the analysis method of the present invention can classify a C region and select "unit of gene name" or "unit of allele" for each region in repertoire classification. Further, CDR3 can also be used instead of D.

Further, in addition to the classification method of IMGT/High-V-QUEST, the present invention can also use combinations such as V (gene name)-D (allele)-J (allele), V (allele)-CDR3-J (allele) or the like. CDR3 can be used as a part of the above-described repertoire classification, or can also be classified individually. Further, the maximum number of sequences that can be processed in one batch is 150,000 in IMGT/High-V-Quest, while it is unlimited in the analysis method of the present invention. The time required for processing the same data is approximately 1/10 in the present system.

<Effects Regarding Therapy>

The cancer idiotype peptide therapeutic method of the present invention is effective for patients when there is no specific marker (molecular target) effective for therapy in a target cancer cell or when there is no effect with therapy by an existing specific molecule targeting agent. That is, since a peptide is made based on genetic information of a cancer cell derived from an individual patient, an effect is exhibited on many tumors expressing a TCR or BCR. Lymphoma cells and leukemia cells, depending on their origins, have T cell based tumors and B cell based tumors. The present technique is applicable to each tumor form and useful in therapy of many patients. Further, when a B cell subpopulation developed into tumor is targeted, an antibody drug is used which targets a cell surface molecule expressed on a majority of B cells such as anti-CD20 antibodies. Such antibody drugs also act on normal B cells. Thus, such drugs act not only on cancer cells, but also on normal cells to induce a side effect such as decrease of immunological capability. Meanwhile, therapy targeting only cancer cells as in the present invention is highly safe. When a cancer peptide is used, highly safe therapy can be materialized by using a more highly specific peptide against cancer cells. Further, existing therapy using a cancer peptide is limited to patients with a specific HLA to which the peptide binds. Meanwhile, a peptide is designed based on genetic information of a patient as in the present invention. Thus, such a peptide is advantageous in being not limited by an HLA type and adaptable to a wide range of patients.

An existing CTL therapeutic method cocultures a lymphocyte of a patient with a tumor cell of the patient and an existing DC therapeutic method cocultures a DC cell of a patient with a tumor cell of the patient to induce a tumor specific killer T cell or a tumor specific DC. In addition, there is therapy using an artificial cancer antigen to stimulate a lymphocyte or DC cell and introduce the antigen into a patient to get an antitumor effect. As an antigen imparting specificity, use of a cancer antigen protein in comparison to the entire tumor cell, and a peptide in comparison to a protein is considered to be more effective and have fewer side effects. Unlike a protein, a peptide is advantageous in that a peptide can be chemically synthesized readily and directly based on genetic sequence information. Safety can be ensured since a peptide does not use biomaterials such as cell, medium, or infectious substance in the manufacturing process thereof. Safe therapy adapted to a wide range of patients can be materialized by designing individual peptides compatible with an HLA of a patient based on the genetic information of a cancer cell.

A synergistic effect is expected from introducing a tumor specific DC cell and CTL cell in a patient autoimmune therapeutic method. A CTL cell is expected to act as a cell already stimulated and activated by an antigen and exert an early therapeutic effect. Since a tumor specific DC cell induces a CTL cell in a patient introduced therewith, there is a sustained antitumor effect. Thus, a synergistic antitumor effect is expected from combined use of such different cells.

In cancer specific TCR gene therapy, it is important that expression of a target antigen is limited to cancer cells. An antigen localized in limited tissue such as cancer cells and testicular tissue, as in cancer-testicular antigens, is selected in therapy. However, it is known that such antigens are also expressed in some normal cells, which may be a safety related issue in therapy in some cases. Tailor-made cancer TCR gene therapy of the technique of the present invention identifies a T cell that infiltrates a patient's tumor tissue and utilizes a genetic sequence of a TCR thereof. Thus, a functional TCR considered to actually have antitumor action in a patient's body is utilized. Hence, a higher level of effect is expected. Further, since it is a T cell in a patient's body, it is highly likely that the action on normal cells is limited. Existing TCR gene therapy is limited to patients having a specific HLA and expressing a target cancer antigen. On the other hand, tailor-made therapy can make a TCR individually that is specific to a cancer antigen derived from a patient and compatible with a patient's HLA, such that therapy targeting a wider range of patients would be possible. Isolation of a cancer specific TCR gene with an in vitro stimulation is performed by stimulating a lymphocyte of a patient with an antigen protein, antigen peptide, inactivated cancer cell, idiotype peptide or the like. A TCR gene isolated via an experimental process for each patient is a TCR adapted to the HLA type of a patient, cancer cell form, cancer antigen species or other genetic background and is considered to be more effective in therapy.

BRIEF DESCRIPTION OF DRAWINGS

FIG. 6A shows analysis with HighV-Quest of IMGT.

FIGS. 7A and 7B show analysis with HighV-Quest of IMGT.

FIGS. 7A and 7B show analysis with HighV-Quest of IMGT.

FIGS. 8A and 8B show analysis with HighV-Quest of IMGT.

FIGS. 8A and 8B show analysis with HighV-Quest of IMGT.

FIG. 9A, where a significant difference among subclasses was not observed unlike an IGHV repertoire, shows analysis with HighV-Quest of IMGT.

FIG. 12 shows a parameter setting of a TCR/BCR repertoire analysis software (Repertoire genesis).

FIG. 13 (A-D) show results of analysis of a TRAV repertoire in healthy individuals. Each figure shows a TRAV repertoire for each sample (see numbers). The horizontal axis indicates each TRAV gene name and the vertical axis indicates the frequency of presence thereof. Mean indicates the mean. A TRBV repertoire for 10 healthy individuals and the mean value thereof are shown. The frequency of presence of TRAV9-2, 12 and 13 were high. TRAV20 in #1 and TRAV21 in #5 were higher than other healthy individuals, exhibiting variations among individuals.

FIG. 13 (A-D) show results of analysis of a TRAV repertoire in healthy individuals. Each figure shows a TRAV repertoire for each sample (see numbers). The horizontal axis indicates each TRAV gene name and the vertical axis indicates the frequency of presence thereof. Mean indicates the mean. A TRBV repertoire for 10 healthy individuals and the mean value thereof are shown. The frequency of presence of TRAV9-2, 12 and 13 were high. TRAV20 in #1 and TRAV21 in #5 were higher than other healthy individuals, exhibiting variations among individuals.

FIG. 13 (A-D) show results of analysis of a TRAV repertoire in healthy individuals. Each figure shows a TRAV repertoire for each sample (see numbers). The horizontal axis indicates each TRAV gene name and the vertical axis indicates the frequency of presence thereof. Mean indicates the mean. A TRBV repertoire for 10 healthy individuals and the mean value thereof are shown. The frequency of presence of TRAV9-2, 12 and 13 were high. TRAV20 in #1 and TRAV21 in #5 were higher than other healthy individuals, exhibiting variations among individuals.

FIG. 14 (A-D) show results of analysis of a TRBV repertoire in healthy individuals. Each figure shows a TRABV repertoire for each sample (see numbers). The horizontal axis indicates each TRBV gene name and the vertical axis indicates the frequency of presence thereof. Mean indicates the mean. A TRBV repertoire for 10 healthy individuals and the mean value thereof are shown. The frequency of presence of TRBV20-1, 28 and 29-1 are high. TRBV3-1 in #8 was higher than other healthy individuals, exhibiting variations among individuals.

FIG. 15 (A-D) shows results of analysis of a TRAJ repertoire in healthy individuals. The horizontal axis indicates each TRAJ gene name and the vertical axis shows the frequency of presence thereof. Mean indicates the mean. A TRAJ repertoire for 10 healthy individuals and the mean value thereof are shown. A TRAJ repertoire of healthy individuals showed about 5% or less in any AJ family. TRAJ12 in #1, TRAJ27 in #4, TRAJ37 in #5, and TRAJ45 in #8 were higher than other healthy individuals, exhibiting variations among individuals.

FIG. 15 (A-D) shows results of analysis of a TRAJ repertoire in healthy individuals. The horizontal axis indicates each TRAJ gene name and the vertical axis shows the frequency of presence thereof. Mean indicates the mean. A TRAJ repertoire for 10 healthy individuals and the mean value thereof are shown. A TRAJ repertoire of healthy individuals showed about 5% or less in any AJ family. TRAJ12 in #1, TRAJ27 in #4, TRAJ37 in #5, and TRAJ45 in #8 were higher than other healthy individuals, exhibiting variations among individuals.

FIG. 15 (A-D) shows results of analysis of a TRAJ repertoire in healthy individuals. The horizontal axis indicates each TRAJ gene name and the vertical axis shows the frequency of presence thereof. Mean indicates the mean. A TRAJ repertoire for 10 healthy individuals and the mean value thereof are shown. A TRAJ repertoire of healthy individuals showed about 5% or less in any AJ family. TRAJ12 in #1, TRAJ27 in #4, TRAJ37 in #5, and TRAJ45 in #8 were higher than other healthy individuals, exhibiting variations among individuals.

FIG. 15 (A-D) shows results of analysis of a TRAJ repertoire in healthy individuals. The horizontal axis indicates each TRAJ gene name and the vertical axis shows the frequency of presence thereof. Mean indicates the mean. A TRAJ repertoire for 10 healthy individuals and the mean value thereof are shown. A TRAJ repertoire of healthy individuals showed about 5% or less in any AJ family. TRAJ12 in #1, TRAJ27 in #4, TRAJ37 in #5, and TRAJ45 in #8 were higher than other healthy individuals, exhibiting variations among individuals.

FIG. 17 is a visualized result of electrophoresis of each 2$^{nd}$ PCR amplicon synthesized in Preparation Example 3 with 2% agarose gel for verifying amplicons with a size of interest.

FIGS. 18-25 are explained. Each set sequence in the full-length sequence is merely an exemplification. A first TCR or BCR C region specific primer can be set on the most 5' terminal side of a complementary DNA. Once a first TCR or BCR C region specific primer is set, a second TCR or BCR C region specific primer can be set downstream thereof. Furthermore, once a second TCR or BCR C region specific primer is set, a third TCR or BCR C region specific primer can be set.

FIG. 19 shows an example of a possible primer setting region of TRGC on the top row (target sequence is an artificially spliced functional TRGC exon region sequence, consisting of exons EX1, EX2, and EX3; and a primer can be set throughout the entire length). The bottom row shows a possible primer setting region of TRDC (target sequence is an artificially spliced functional TRDC exon region sequence, consisting of exons EX1, EX2, EX3 and EX4; and a primer can be set throughout the entire length). It is understood that a TRGC sequence used as a target sequence can be the illustrated sequence (SEQ ID NO: 1378) as well as SEQ ID NOs: 1394, 1395, 1396, 1397, 1398, 1399 and mutants thereof. It is understood that a TRDC sequence used as a target sequence can be the illustrated sequence (SEQ ID NO: 1379) as well as mutants thereof.

FIG. 20 shows an example of a possible primer setting region of IGHM (target sequence is an artificially spliced functional IGHM exon region sequence, a secreted form consisting of exons CH1, CH2, CH3, CH4 and CH-5, and a membrane bound form consisting of CH1, CH2, CH3, CH4, M1 and M2. The figure shows an example of a membrane bound form. It is understood that an IGHM sequence used as a target sequence can be the illustrated sequence (SEQ ID NO: 1380) as well as SEQ ID NOs: 1447, 1448, 1449, and mutants thereof. A primer can be set throughout the entire length).

FIG. 21 shows an example of a possible primer setting region of IGHA (target sequence is an artificially spliced functional IGHA exon region sequence, secreted form consisting of exons CH1, H, CH2, CH3, and CH-5, and a membrane bound form consisting of CH1, H, CH2, CH3, M1 and M2. The figure shows an example of a secreted form. It is understood that an IGHA sequence used as a target sequence can be the illustrated sequence (SEQ ID NO: 1381) as well as SEQ ID NOs: 1400, 1401, 1402, 1403 and mutants thereof. A primer can be set throughout the entire length).

FIG. 22 shows an example of a possible primer setting region of IGHG (target sequence is an artificially spliced functional IGHG exon region sequence, secreted form consisting of exons CH1, H, (H1, H2, H3, H4), CH2, CH3, and CH-5, and a membrane bound form consisting of CH1, H (H1, H2, H3, H4), CH2, CH3, M1 and M2. The figure shows an example of a secreted form. It is understood that an IGHG sequence used as a target sequence can be the illustrated sequence (SEQ ID NO: 1382) as well as SEQ ID NOs; 1412-1446 and mutants thereof. A primer can be set throughout the entire length).

FIG. 23 shows an example of a possible primer setting region of IGHD (target sequence is an artificially spliced functional IGHD exon region sequence, secreted form consisting of exons CH1, H1, H2, CH2, CH3, and CH-5, and a membrane bound form consisting of CH1, H1, H2, CH2, CH3, M1 and M2. The figure shows an example of a membrane bound form. It is understood that an IGHD sequence used as a target sequence can be the illustrated sequence (SEQ ID NO: 1383) as well as SEQ ID NOs: 1404-1406 and mutants thereof. A primer can be set throughout the entire length).

FIG. 24 shows an example of a possible primer setting region of IGHE (target sequence is an artificially spliced functional IGHE exon region sequence, secreted form consisting of exon CH1, exon CH2, exon CH3, and CH-5, and a membrane bound form consisting of CH1, exon CH2, exon CH3, M1 and M2. The figure shows an example of a secreted form. It is understood that an IGHE sequence used as a target sequence can be the illustrated sequence (SEQ ID NO: 1384) as well as SEQ ID NOs: 1407-1411 and mutants thereof. A primer can be set throughout the entire length).

FIG. 25 shows an example of a possible primer setting region of IGKC on the top row (target sequence is a functional IGKC CL sequence. It is understood that an IGKC sequence used as a target sequence can be the illustrated sequence (SEQ ID NO: 1379) as well as mutants thereof. A primer can be set throughout the entire length). The bottom row shows a possible primer setting region of IGLC (target sequence is a functional IGLC CL sequence. It is understood that an IGLC sequence used as a target sequence can be the illustrated sequence (SEQ ID NO: 1379) as well as mutants thereof. A primer can be set throughout the entire length).

FIG. 27 (A-D) show TCR reads in serially diluted Molt-4 cell samples (SEQ ID NOs: 1165-1324). TCR reads acquired from each of 10%, 1%, 0.1%, and 0.01% serially diluted Molt-4 sample are described. The reads were ranked in the order of having a greater number of reads and the top 40 positions are shown. Ranking 365 to 404 are shown for the 0.01% sample. TRBV, TRBJ, and CDR3 amino acid sequences for each read, and number of reads are shown. Functional TCR reads (TRBV20-1/TRBJ2-1/CSAREST-SDPKNEQFFG) (SEQ ID NO: 1163) derived from Molt-4 are shown in bold with a gray background. The other TCR reads estimated to have a functional deficiency (TRBV10-3/TRBJ2-5/CAISEPTGIRRDPVLR) (SEQ 1D, NO 1164) are shown in bold.

FIG. 27 (A-D) show TCR reads in serially diluted Molt-4 cell samples (SEQ ID NOs: 1165-1324). TCR reads acquired from each of 10%, 1%, 0.1%, and 0.01% serially diluted Molt-4 sample are described. The reads were ranked in the order of having a greater number of reads and the top 40 positions are shown. Ranking 365 to 404 are shown for the 0.01% sample. TRBV, TRBJ, and CDR3 amino acid sequences for each read, and number of reads are shown. Functional TCR reads (TRBV20-1/TRBJ2-1/CSAREST-SDPKNEQFFG) (SEQ ID NO: 1163) derived from Molt-4 are shown in bold with a gray background. The other TCR reads estimated to have a functional deficiency (TRBV10-3/TRBJ2-5/CAISEPTGIRRDPVLR) (SEQ ID NC 1164) are shown in bold.

FIG. 27 (A-D) show TCR reads in serially diluted Molt-4 cell samples (SEQ ID NOs: 1165-1324). TCR reads acquired from each of 10%, 1%, 0.1%, and 0.01% serially diluted Molt-4 sample are described. The reads were ranked in the order of having a greater number of reads and the top 40 positions are shown. Ranking 365 to 404 are shown for the 0.01% sample. TRBV, TRBJ, and CDR3 amino acid sequences for each read, and number of reads are shown. Functional TCR reads (TRBV20-1/TRBJ2-1/CSAREST-SDPKNEQFFG) (SEQ ID NO: 1163) derived from Molt-4 are shown in bold with a gray background. The other TCR reads estimated to have a functional deficiency (TRBV10-3/TRBJ2-5/CAISEPTGIRRDPVLR) (SEQ ID NO: 1164) are shown in bold.

FIG. 27 (A-D) show TCR reads in serially diluted Molt-4 cell samples (SEQ ID NOs: 1165-1324). TCR reads acquired from each of 10%, 1%, 0.1%, and 0.01% serially diluted Molt-4 sample are described. The reads were ranked in the order of having a greater number of reads and the top 40 positions are shown. Ranking 365 to 404 are shown for the 0.01% sample. TRBV, TRBJ, and CDR3 amino acid sequences for each read, and number of reads are shown. Functional TCR reads (TRBV20-1/TRBJ2-1/CSAREST-SDPKNEQFFG) (SEQ ID NO: 1163)derived from Molt-4 are shown in bold with a gray background. The other TCR reads estimated to have a functional deficiency (TRBV10-3/TRBJ2-5/CAISEPTGIRRDPVLR) (SEQ ID NO: 1164) are shown in bold.

FIG. 29 is a schematic diagram showing the flow of TCR data analysis.

FIG. 30 is a schematic diagram showing the flow of BCR data analysis.

DESCRIPTION OF EMBODIMENTS

Figure 1:
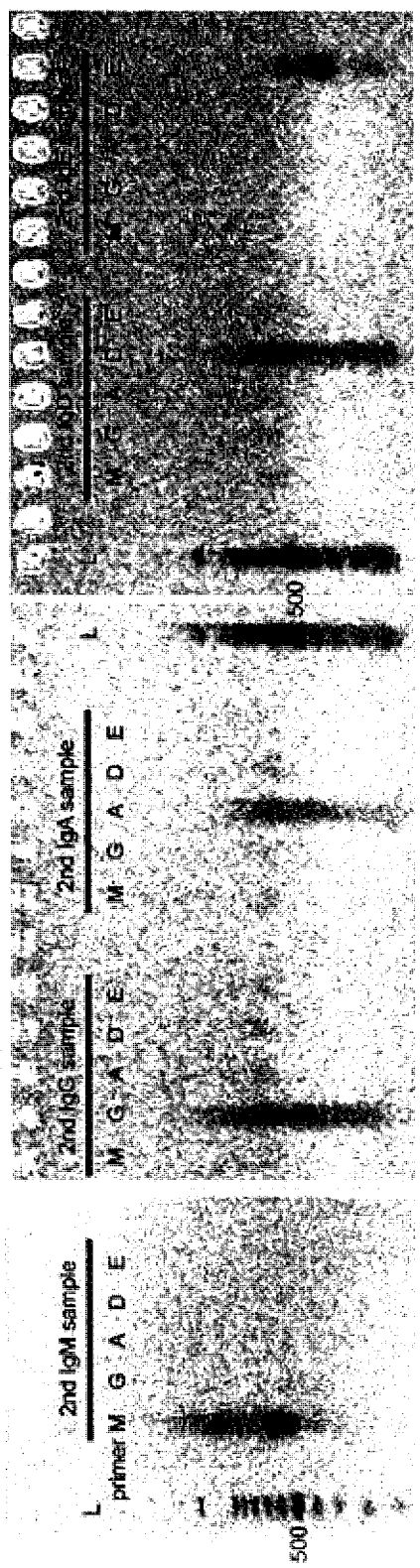
FIG. 1 shows cross-reactivity of an isotype specific primer. The left panel is an example related to a second IgM sample. The left end (L) shows a lane for a molecular weight marker. M, G, A, D, and E show results with IgM, IgG, IgA, IgD and IgE specific primers, respectively. The middle panel shows a result with a second IgG sample on the left side and a result with a second IgA sample on the right side. The right end (L) shows a lane for a molecular weight marker. M, G, A, D and E show results with IgM, IgG, IgA, IgD and IgE specific primers, respectively. The right panel shows a second IgD sample on the left side and a second IgE sample on the right side. The left end (L) shows a lane for a molecular weight marker. M, G, A, D and E show results with IgM, IgG, IgA, IgD and IgE specific primers, respectively. To assess the specificity of an immunoglobulin isotype specific primer that was used, amplification was performed with an immunoglobulin isotype specific primer of interest and another isotype specific primer to verify the presence of cross-reactivity. 10 μL of GS-PCR amplicon, after electrophoresis in a TAE buffer with 2% agarose gel, was assessed with ethidium bromide staining. A $2^{nd}$ PCR amplicon amplified with each isotype specific primer was not amplified with another isotype specific GS-PCR primer, verifying that the primers are highly specific.

The present invention is described hereinafter. Throughout the entire specification, a singular expression should be understood as encompassing the concept thereof in the plural form unless specifically noted otherwise. Thus, singular articles (e.g., "a", "an", "the" and the like in case of English) should also be understood as encompassing the concept thereof in the plural form unless specifically noted otherwise. Further, the terms used herein should be understood as being used in the meaning that is commonly used in the art, unless specifically noted otherwise. Thus, unless defined otherwise, all terminologies and scientific technical terms that are used herein have the same meaning as the terms commonly understood by those skilled in the art pertaining to the present invention. In case of a contradiction, the present specification (including the definitions) takes precedence.

As used herein, "database" refers to any database related to genes and especially to a database comprising T cell receptor and B cell receptor repertoires in the present invention. Examples of such a database include, but are not limited to, IMGT (the international ImMunoGeneTics information system, www dot img dot org) database, DNA Data Bank of Japan (DDBJ, DNA Data Bank of Japan, www dot ddbj dot nig dot ac dot jp) database, GenBank (National Center for Biotechnology Information. www dot ncbi dot nlm dot nih dot gov/genbank/) database, ENA (EMBL (European Molecular Biology Laboratory), www dot ebi dot ac dot uk/ena) and the like.

As used herein, "genetic sequence analysis" or "gene sequencing" refers to analysis of a constituent nucleic acid sequence and/or amino acid sequence of a gene. "Genetic sequence analysis" or "gene sequencing" includes any analysis associated with a gene such as determination of a base or residue, determination of homology, determination of a domain, or determination of a latent function.

As used herein, "T cell receptor (TCR)" refers to a T cell receptor or a T cell antigen receptor, or a receptor expressed on a cell membrane of a T cell that regulates an immune system, and recognizes an antigen. There are α chain, β chain, γ chain and δ chain, constituting an αβ or γδ dimer. A TCR consisting of the former combination is called an αβ TCR and a TCR consisting of the latter combination is called a γδ TCR. T cells having such TCRs are called αβ T cell or γδ T cell. The structure is very similar to a Fab fragment of an antibody produced by a B cell, and recognizes an antigen molecule bound to an MHC molecule. Since a TCR gene of a mature T cell has undergone gene rearrangement, an individual has a diverse TCR and is able to recognize various antigens. A TCR further binds to an invariable CD3 molecule present in a cell membrane to form a complex. CD3 has an amino acid sequence called the ITAM (immunoreceptor tyrosine-based activation motif) in an intracellular region. This motif is considered to be involved in intracellular signaling. Each TCR chain is composed of a variable section (V) and a constant section (C). The constant section penetrates through the cell membrane and has a short cytoplasm portion. The variable section is present extracellularly and binds to an antigen-MHC complex. The variable section has three regions called a hypervariable section or a complementarity determining region (CDR), which binds to an antigen-MHC complex. The three CDRs are each called CDR1, CDR2, and CDR3. For a TCR, CDR1 and CDR2 are considered to bind to an MHC, while CDR3 is considered to bind to an antigen. Gene rearrangement of a TCR is similar to the process for a B cell receptor known as an immunoglobulin. In gene rearrangement of an αβ TCR, VDJ rearrangement of a β chain is first performed and then VJ rearrangement of an α chain is performed. Since a gene of a δ chain is deleted from a chromosome in rearrangement of an α chain, a T cell having an αβ TCR would not simultaneously have a γδ TCR. In contrast, in a T cell having a γδ TCR, a signal mediated by this TCR suppresses expression of a β chain. Thus, a T cell having a γδ TCR would not simultaneously have an αβ TCR.

As used herein, "B cell receptor (BCR)" is also called a B cell receptor or B cell antigen receptor and refers to those composed of an Igα/Igβ (CD79a/CD79b) heterodimer (α/β) conjugated with a membrane-bound immunoglobulin (mIg). An mIg subunit binds to an antigen to induce aggregation of the receptors, while an α/β subunit transmits a signal to the inside of a cell. BCRs, when aggregated, are understood to quickly activate Lyn, Blk, and Fyn of Src family kinases as in Syk and Btk of tyrosine kinases. Results greatly differ depending on the complexity of BCR signaling, the results including survival, resistance (allergy; lack of hypersensitivity reaction to antigen) or apoptosis, cell division, differentiation into antibody-producing cell or memory B cell and the like. Several hundred million types of T cells with a different TCR variable region sequence are produced and several hundred million types of B cells with a different BCR (or antibody) variable region sequence are produced. Individual sequences of TCRs and BCRs vary due to an introduced mutation or rearrangement of the genomic sequence. Thus, it is possible to obtain a clue for antigen specificity of a T cell or a B cell by determining a genomic sequence of TCR/BCR or a sequence of an mRNA (cDNA).

As used herein, "V region" refers to a variable section (V) of a variable region of a TCR chain or a BCR chain.

As used herein, "D region" refers to a D region of a variable region of a TCR chain or a BCR chain.

As used herein, "J region" refers to a J region of a variable region of a TCR chain or a BCR chain.

As used herein, "C region" refers to a constant section (C) region of a TCR chain or a BCR chain.

As used herein, "repertoire of a variable region" refers to a collection of V(D)J regions created in any manner by gene rearrangement in a TCR or BCR. The terms such as TCR repertoire and BCR repertoire are used, which are also called, for example, T cell repertoire, B cell repertoire or the like in some cases. For instance, "T cell repertoire" refers to a collection of lymphocytes characterized by expression of a T cell receptor (TCR) serving an important role in antigen recognition. A change in a T cell repertoire provides a significant indicator of an immune status in a physiological condition and disease condition. Thus, a T cell repertoire has been analyzed to identify an antigen specific T cell involved in the pathology of a disease and diagnosis of abnormality in T lymphocytes. Comparison of the variable region usage by fluorescence activated cell sorter analysis which uses a larger panel of a TCR variable region specific antibody (van den Beemd R et al. (2000) Cytometry 40: 336-345; MacIsaac C et al. (2003) J Immunol Methods 283: 9-15; Tembhare P et al. (2011) Am J Clin Pathol 135: 890-900; Langerak A W et al. (2001) Blood 98: 165-173), by polymerase chain reaction (PCR) using multiple primers (Rebai N et al. (1994) Proc Natl Acad Sci USA 91: 1529-1533), or by enzyme-linked immunosorbent assay based on PCR (Matsutani T et al. (1997) Hum Immunol 56: 57-69; Matsutani T et al. (2000) Br J Haematol 109: 759-769) have been extensively used to detect a change in a T cell repertoire. Analysis of a chain length distribution known as CDR3 spectratyping is based on the addition of a nontemplate nucleotide in a V-(D)-J region and has been used to assess clonality and diversity of T cells (Matsutani T et al. (2007) Mol Immunol 44: 2378-2387; Matsutani T et al. (2011) Mol Immunol 48: 623-629). To further identify the antigen specificity of a T cell, PCR cloning of a TCR clone type and subsequence sequencing of an antigen recognition region and CDR3 were required. Such conventional approach is commonly used. However, this is a time and labor intensive method for researching a TCR repertoire.

As used herein, "quantitative analysis" refers to analysis that is quantitative in nature. In the present invention, "quantitative analysis" refers to analysis in a form reflecting the amount of each clone that was originally present in repertoire analysis.

As used herein, "sample" includes, but is not limited to, components derived from a subject (body fluid such as blood or the like).

As used herein, "complementary DNA" refers to a DNA forming a complementary strand with respect to a target nucleic acid molecule, e.g., RNA included in an RNA sample or the like derived from a target cell.

As used herein, "double stranded complementary DNA" refers to DNAs that are complementary to each other and form a double strand. In the present invention, this can be produced, for example, with a complementary DNA forming a complementary strand with respect to an RNA included in an RNA sample or the like derived from a target cell as a template.

As used herein, "common adaptor primer sequence" refers to a sequence of a portion added in common to all sequences in an adaptor-added double stranded complementary DNA used as a primer in the first PCR amplification reaction and the second PCR amplification reaction of the present invention.

As used herein, "adaptor-added double stranded complementary DNA" refers to a DNA used as a primer in the first PCR in the present invention, wherein a common adaptor primer sequence is added to various double stranded complementary DNAs in a sample. This is used as a template in the first primer amplification reaction.

As used herein, "common adaptor primer" refers to a DNA used as a primer in the first PCR reaction and the second PCR amplification reaction of the present invention, wherein a single common sequence is used in each reaction.

As used herein, "first TCR or BCR C region specific primer" refers to a primer used in the first PCR amplification reaction of the present invention, comprising a sequence specific to a C region of a TCR or a BCR.

Figure 18:
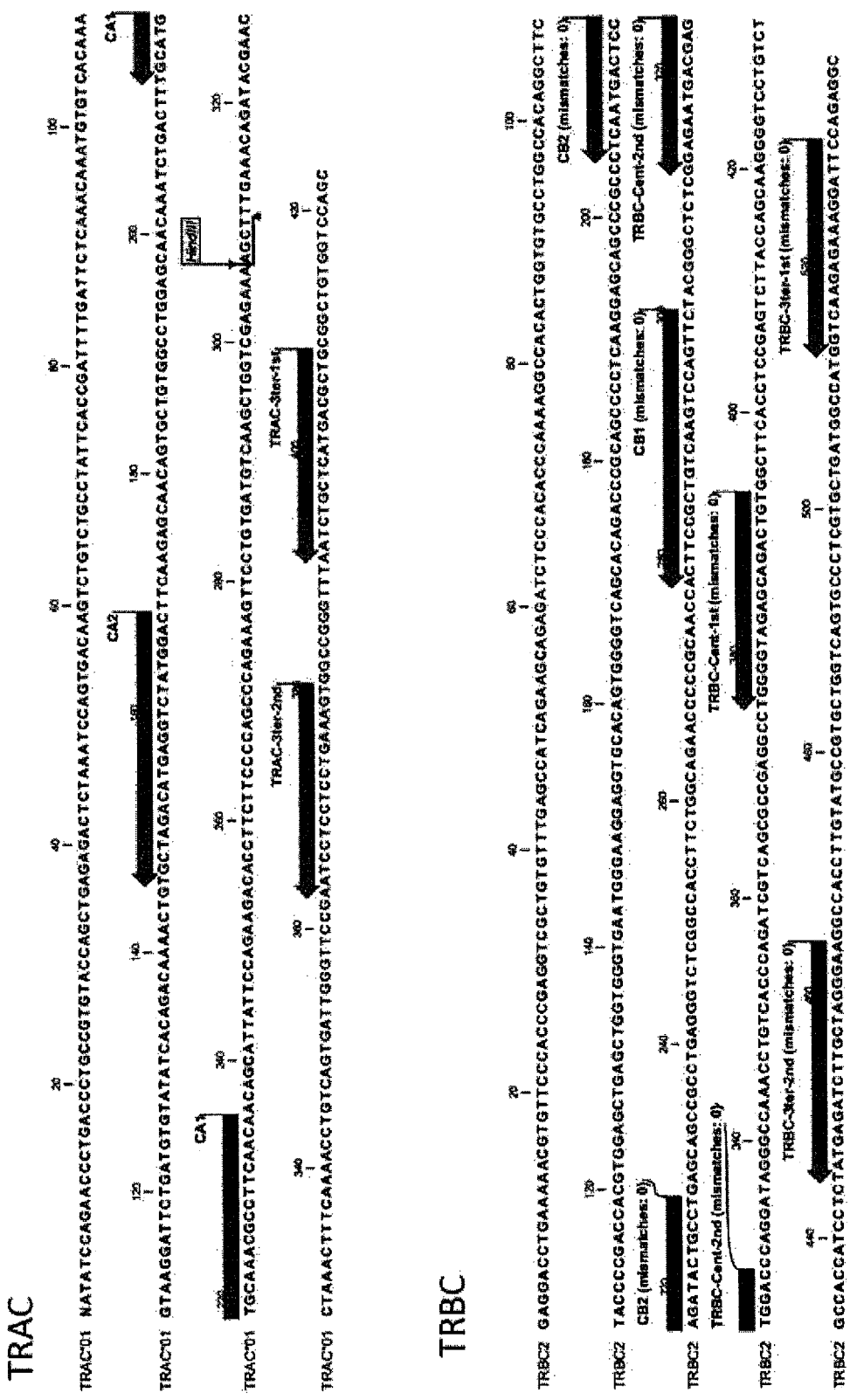
FIG. 18 shows an example of a possible primer setting region of TRAC on the top row (target sequence is an artificially spliced functional TRAC exon region sequence, consisting of exons EX1, EX2, and EX3; and a primer can be set throughout the entire length). The bottom row shows a possible primer setting region of TRBC (target sequence is an artificially spliced functional TRBC exon region sequence, consisting of exons EX1, EX2, EX3 and EX4; and a primer can be set throughout the entire length). It is understood that a TRAC sequence used as a target sequence can be the illustrated sequence (SEQ ID NO: 1376) as well as mutants thereof. It is understood that a TRBC sequence used as a target sequence can be the illustrated sequence (SEQ ID NO: 1377) as well as SEQ ID NOs: 1392, 1393 and other mutants thereof.

FIG. 18 shows an example of a possible primer setting region of TRAC on the top row (target sequence is an artificially spliced functional TRAC exon region sequence, consisting of exons EX1, EX2, and EX3; and a primer can be set throughout the entire length). The bottom row shows an example of a possible primer setting region of TRBC (target sequence is an artificially spliced functional TRBC exon region sequence, consisting of exons EX1, EX2, EX3 and EX4; and a primer can be set throughout the entire length). In addition, a first TCR or BCR C region specific primer can be set on the most 5' terminal side of a complementary DNA. Once a first TCR or BCR C region specific primer is set, a second TCR or BCR C region specific primer can be set downstream thereof. Furthermore, once the second TCR or BCR C region specific primer is set, a third TCR or BCR C region specific primer can be set. That is, when the first is set, the second is downstream thereof, and the third is further downstream. Theoretically, it is understood that the primers only need to be downstream by the length of the primer.

Figure 19:
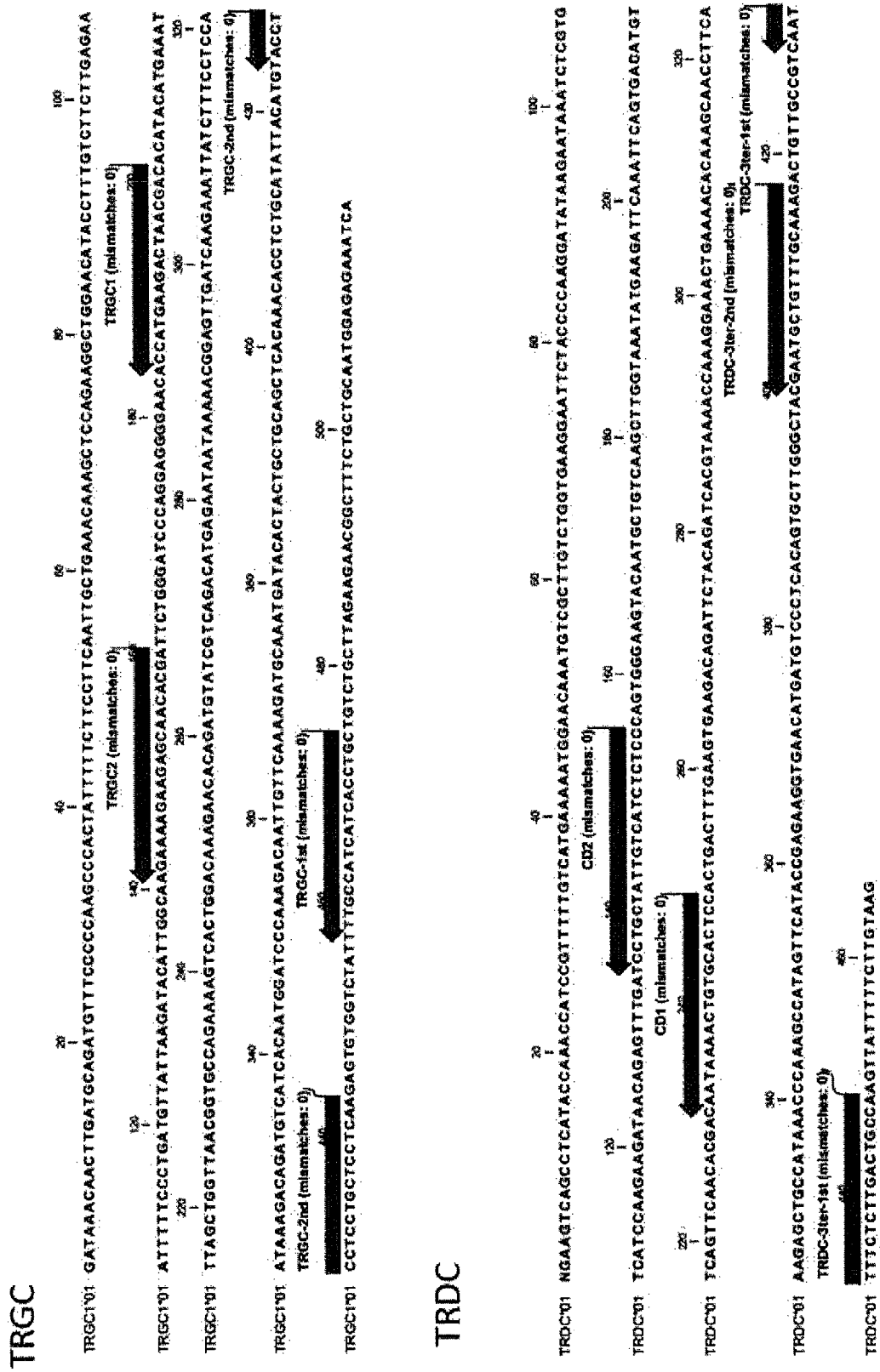

FIG. 19 shows an example of a possible primer setting region of TRGC on the top row (target sequence is an artificially spliced functional TRGC exon region sequence, consisting of exons EX1, EX2, and EX3; and a primer can be set throughout the entire length). The bottom row shows an example of a possible primer setting region of TRDC (target sequence is an artificially spliced functional TRDC exon region sequence, consisting of exons EX1, EX2, and EX3; and a primer can be set throughout the entire length). In addition, a first TCR or BCR C region specific primer can be set on the most 5' terminal side of a complementary DNA. Once a first TCR or BCR C region specific primer is set, a second TCR or BCR C region specific primer can be set downstream thereof. Furthermore, once the second TCR or BCR C region specific primer is set, a third TCR or BCR C region specific primer can be set. That is, when the first is set, the second is downstream thereof, and the third is further downstream. Theoretically, it is understood that the primers only need to be downstream by the length of the primer.

Figure 20:
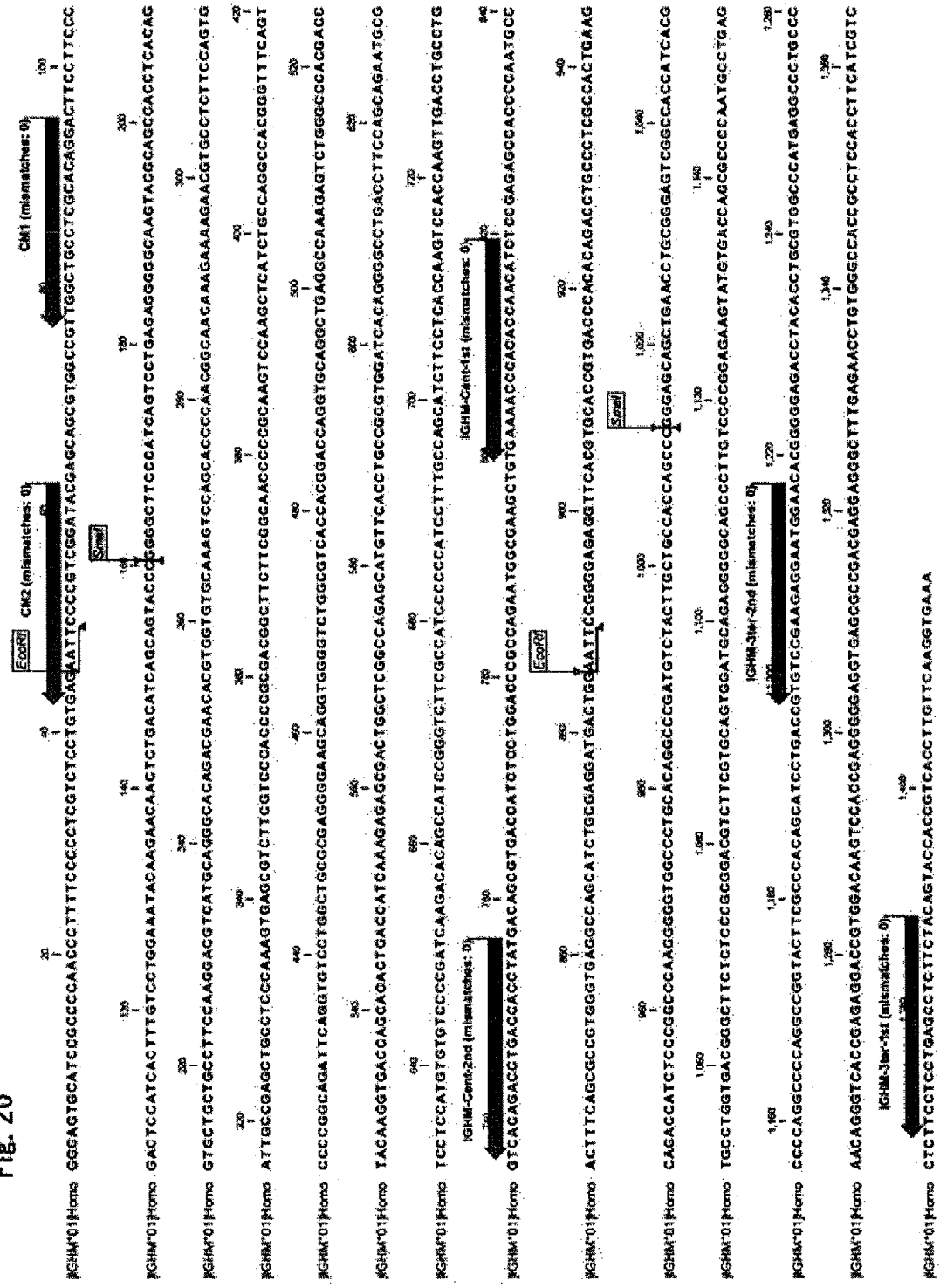

FIG. 20 shows an example of a possible primer setting region of IGHM (target sequence is an artificially spliced functional IGHM exon region sequence, consisting of exons CH1, CH2, CH3, and CH4; and a primer can be set throughout the entire length). In addition, a first TCR or BCR C region specific primer can be set on the most 5' terminal side of a complementary DNA. Once a first TCR or BCR C region specific primer is set, a second TCR or BCR C region specific primer can be set downstream thereof. Furthermore, once the second TCR or BCR C region specific primer is set, a third TCR or BCR C region specific primer can be set. That is, when the first is set, the second is downstream thereof, and the third is further downstream. Theoretically, it is understood that the primers only need to be downstream by the length of the primer.

Figure 21:
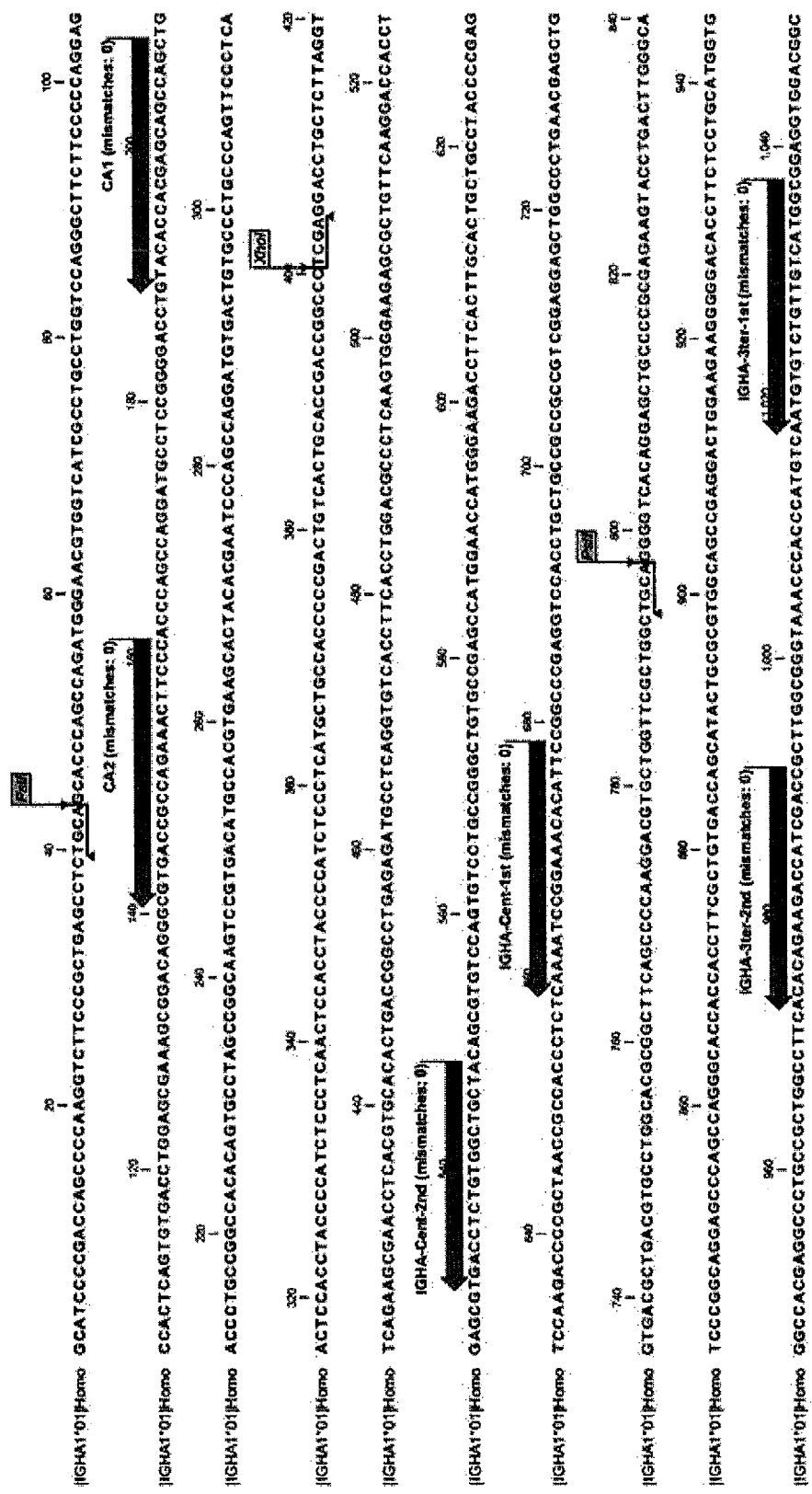

FIG. 21 shows an example of a possible primer setting region of IGHA (target sequence is an artificially spliced functional IGHA exon region sequence. A secreted form consists of exons CH1, H, CH2, CH3, and CH-5, and a membrane bound form consists of CH1, H, CH2, CH3, M1 and M2. A primer can be set throughout the entire length). In addition, a first TCR or BCR C region specific primer can be set on the most 5' terminal side of a complementary DNA. Once a first TCR or BCR C region specific primer is set, a second TCR or BCR C region specific primer can be set downstream thereof. Furthermore, once the second TCR or BCR C region specific primer is set, a third TCR or BCR C region specific primer can be set. That is, when the first is set, the second is downstream thereof, and the third is further downstream. Theoretically, it is understood that the primers only need to be downstream by the length of the primer.

Figure 22:
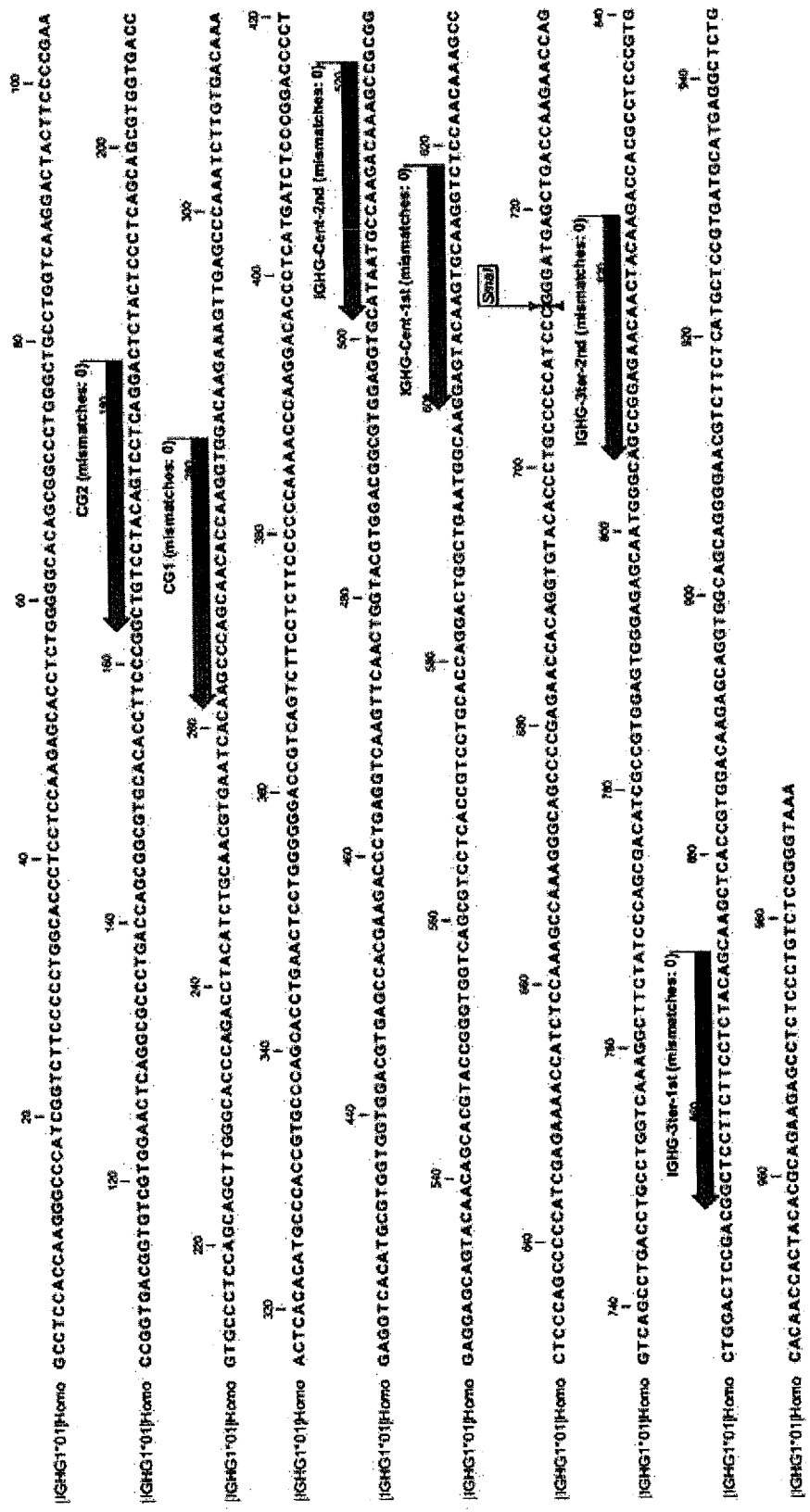

FIG. 22 shows an example of a possible primer setting region of IGHG (target sequence is an artificially spliced functional IGHG exon region sequence. A secreted form consists of exons CH1, H (H1, H2, H3, H4), CH2, CH3, and CH-5, and a membrane bound form consists of CH1, H (H1, H2, H3, H4), CH2, CH3, M1 and M2. A primer can be set throughout the entire length). In addition, a first TCR or BCR C region specific primer can be set on the most 5' terminal side of a complementary DNA. Once a first TCR or BCR C region specific primer is set, a second TCR or BCR C region specific primer can be set downstream thereof. Furthermore, once the second TCR or BCR C region specific primer is set, a third TCR or BCR C region specific primer can be set. That is, when the first is set, the second is downstream thereof, and the third is further downstream. Theoretically, it is understood that the primers only need to be downstream by the length of the primer.

Figure 23:
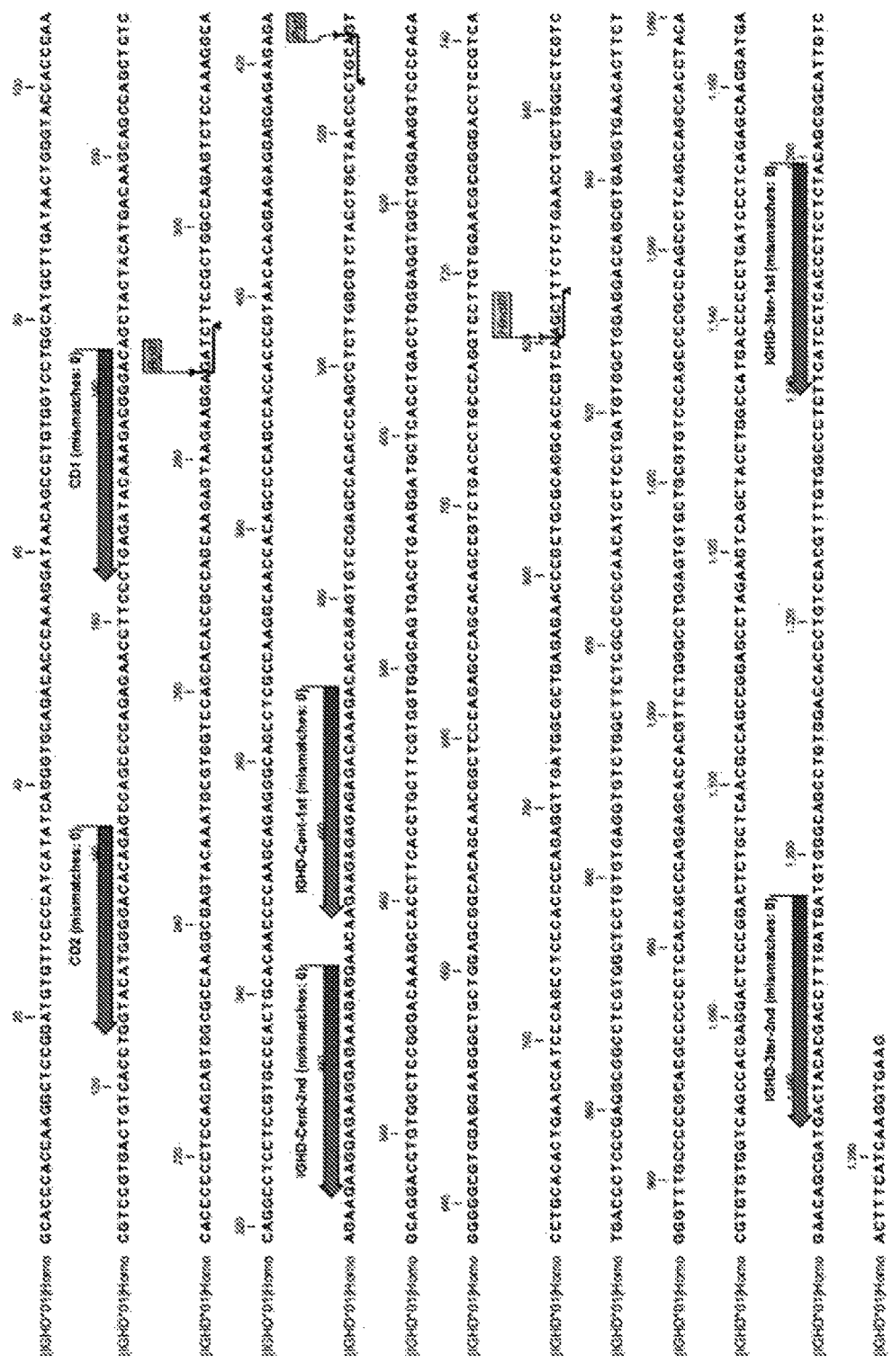

FIG. 23 shows an example of a possible primer setting region of IGHD (target sequence is an artificially spliced functional IGHD exon region sequence. A secreted form consists of exons CH1, H1, H2, CH2, CH3, and CH-5, and a membrane bound form consists of CH1, H1, H2, CH2, CH3, M1 and M2. A primer can be set throughout the entire length). In addition, a first TCR or BCR C region specific primer can be set on the most 5' terminal side of a complementary DNA. Once a first TCR or BCR C region specific primer is set, a second TCR or BCR C region specific primer can be set downstream thereof. Furthermore, once the second TCR or BCR C region specific primer is set, a third TCR or BCR C region specific primer can be set. That is, when the first is set, the second is downstream thereof, and the third is further downstream. Theoretically, it is understood that the primers only need to be downstream by the length of the primer.

Figure 24:
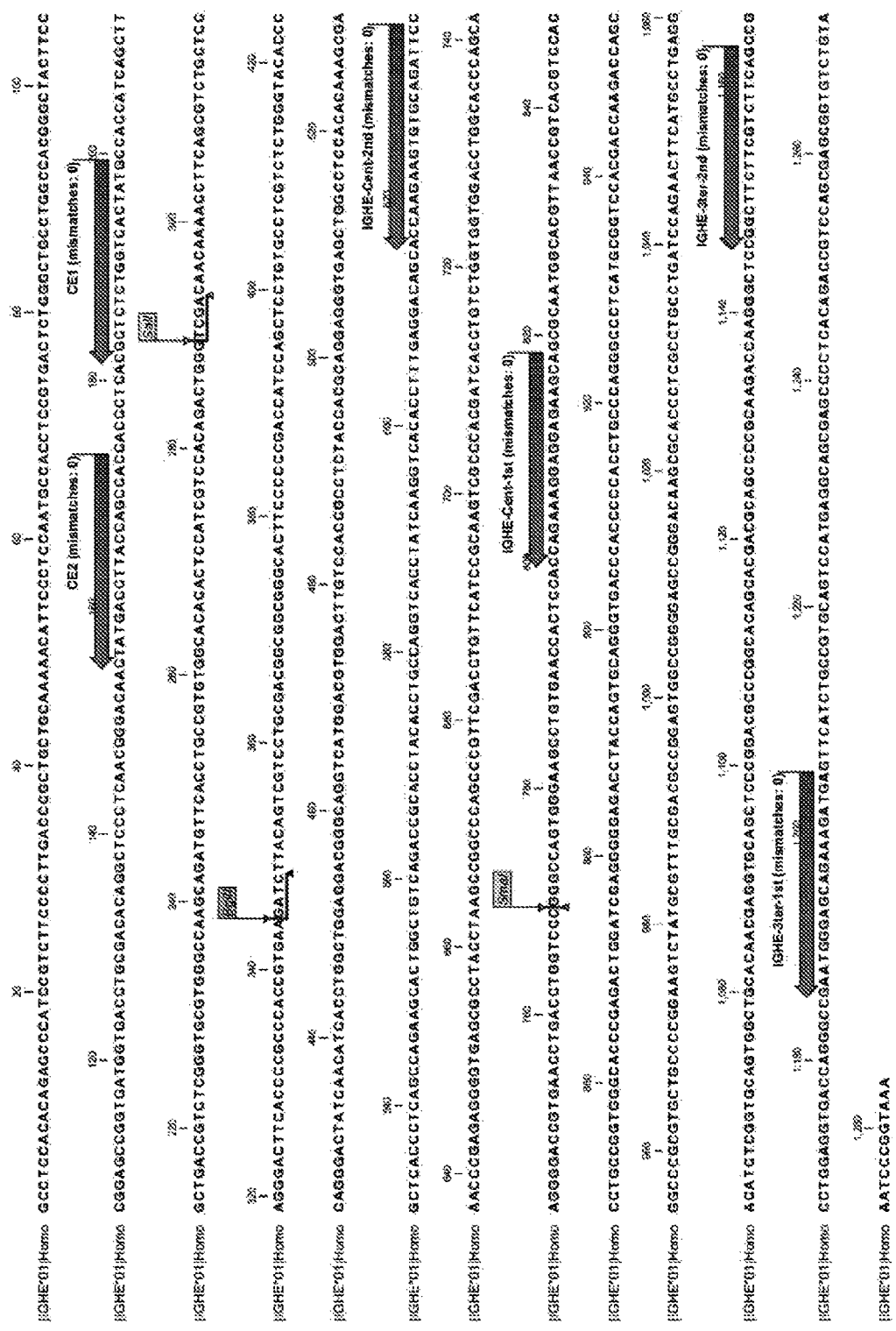

FIG. 24 shows an example of a possible primer setting region of IGHE (target sequence is an artificially spliced functional IGHE exon region sequence. A secreted form consists of exon CH1, exon CH2, exon CH3, and CH-5, and a membrane bound form consists of CH1, exon CH2, exon CH3, M1 and M2. A primer can be set throughout the entire length). In addition, a first TCR or BCR C region specific primer can be set on the most 5' terminal side of a complementary DNA. Once a first TCR or BCR C region specific primer is set, a second TCR or BCR C region specific primer can be set downstream thereof. Furthermore, once the second TCR or BCR C region specific primer is set, a third TCR or BCR C region specific primer can be set. That is, when the first is set, the second is downstream thereof, and the third is further downstream. Theoretically, it is understood that the primers only need to be downstream by the length of the primer.

Figure 25:
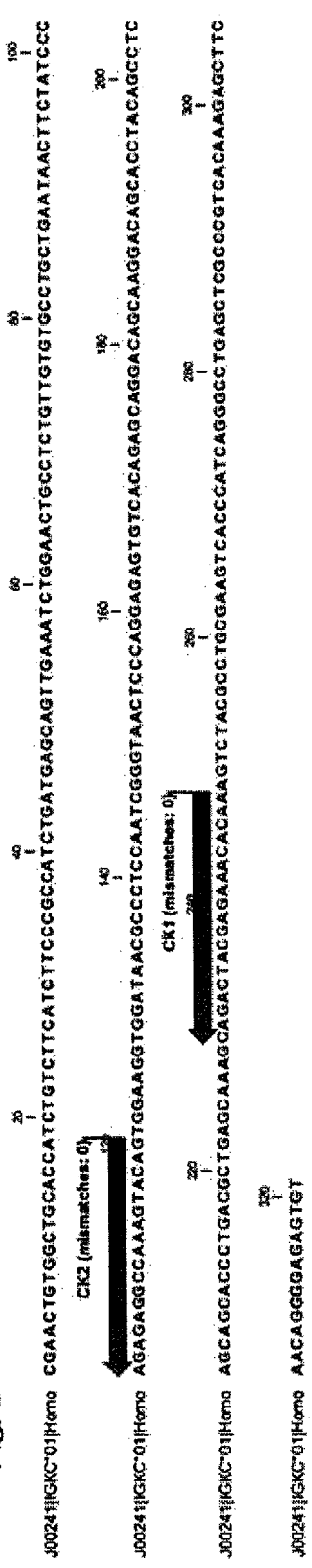

FIG. 25 shows an example of a possible primer setting region of IGKC on the top row (target sequence is a functional IGKC CL sequence. A primer can be set throughout the entire length). The bottom row shows an example of a possible primer setting region of IGLC (target sequence is a functional IGLC CL sequence A primer can be set throughout the entire length). In addition, a first TCR or BCR C region specific primer can be set on the most 5' terminal side of a complementary DNA. Once a first TCR or BCR C region specific primer is set, a second TCR or BCR C region specific primer can be set downstream thereof. Furthermore, once the second TCR or BCR C region specific primer is set, a third TCR or BCR C region specific primer can be set. That is, when the first is set, the second is downstream thereof, and the third is further downstream. Theoretically, it is understood that the primers only need to be downstream by the length of the primer.

Specifically, a first TCR or BCR C region specific primer has the following structure: for BCRs, CM1 (SEQ ID NO: 5), CA1 (SEQ ID NO: 8), CG1 (SEQ ID NO: 11), CD1 (SEQ ID NO: 14), or CE1 (SEQ ID NO: 17), and for TCRs, CA1 (SEQ ID NO: 35) or CB1 (SEQ ID NO: 37) or the like. However, the structure is not limited thereto. Such a primer sequence can be set in, but is not limited to, the following specific ranges. The first, second and third ranges can be set in the entire range, but can be mutually determined.

α sequence of TCR: base number 213 to base number 235 of SEQ ID NO: 1376 (FIG. 18)

β sequence of TCR: base number 278 to base number 300 of SEQ ID NO: 1377 (FIG. 18)

γ sequence of TCR: base number 184 to base number 201 of SEQ ID NO: 1378 (FIG. 19)

δ sequence of TCR: base number 231 to base number 249 of SEQ ID NO: 1379 (FIG. 19)

IgM heavy chain sequence of BCR: base number 77 to base number 95 of SEQ ID NO: 1380 (FIG. 20)

IgA heavy chain sequence of BCR: base number 189 to base number 208 of SEQ ID NO: 1381 (FIG. 21)

IgG heavy chain sequence of BCR: base number 262 to base number 282 of SEQ ID NO: 1382 (FIG. 22)

IgD heavy chain sequence of BCR: base number 164 to base number 183 of SEQ ID NO: 1383 (FIG. 23)

IgE heavy chain sequence of BCR: base number 182 to base number 199 of SEQ ID NO: 1384 (FIG. 24)

Igκ chain constant region sequence of BCR: base number 230 to base number 248 of SEQ ID NO: 1385 (FIG. 25)

Igλ chain sequence of BCR: base number 273 to base number 291 of SEQ ID NO: 1386 (FIG. 25)

As used herein, "specific" refers to binding to a target sequence, but binding poorly and preferably not binding to other sequences at least in a pool of target TCRs or BCRs and preferably in all sequences of TCRs or BCRs that are present. A specific sequence would be advantageously and preferably, but not necessarily limited to, fully complementary to a target sequence.

As used herein, "sufficiently specific (to a C region of interest)" refers to having sufficient specificity for a gene amplification reaction. The same sequence as a target C region would be advantageous and preferable, but it is not necessarily limited thereto.

As used herein, "first PCR amplification reaction" is a PCR amplification reaction performed in the first stage of the method of preparing a sample of the present invention.

As used herein, "not homologous with other genetic sequences" refers to having low homology to such an extent that a gene amplification reaction does not occur with sequences other than the sequence of interest (e.g., C region of interest of a TCR or BCR).

As used herein, "comprising a mismatching base (between subtypes) downstream" refers to comprising a mismatching base between subtypes, downstream of a sequence that is used when set as a primer. An amplicon would have a different sequence for each subtype by setting such a sequence. Thus, a subtype can be identified by determining a sequence.

As used herein, "second TCR or BCR C region specific primer" refers to a primer used in the second PCR amplification reaction of the present invention, comprising a sequence specific to a C region of a TCR or BCR. A second TCR or BCR C region specific primer is designed to have a sequence that is a complete match with the TCR or BCR C region in a sequence downstream the sequence of the first TCR or BCR C region specific primer, but comprise a sequence that is not homologous with other genetic sequences, and comprise a mismatching base between subtypes downstream when amplified. Examples of such a sequence include, but are not limited to, CM2 (SEQ ID NO: 6), CA2 (SEQ ID NO: 9), CG2 (SEQ ID NO: 12), CD2 (SEQ ID NO: 15), and CE2 (SEQ ID NO: 18) for BCRs, and CA2 (SEQ ID NO: 36) and CB2 (SEQ ID NO: 38) for TCRs and the like. Such a primer sequence can be set in, but is not limited to, the following specific ranges. The first, second and third ranges can be set in the entire range, but can be mutually determined. That is, when the first is set, the second is downstream thereof, and the third is further downstream. Theoretically, it is understood that the primers only need to be downstream by the length of the primer.

α sequence of TCR: base number 146 to base number 168 of SEQ ID NO: 1376 (FIG. 18), β sequence of TCR: base number 205 to base number 227 of SEQ ID NO: 1377 (FIG. 18), γ sequence of TCR: base number 141 to base number 160 of SEQ ID NO: 1378 (FIG. 19), δ sequence of TCR: base number 135 to base number 155 of SEQ ID NO: 1379 (FIG. 19), IgM heavy chain sequence of BCR: base number 43 to base number 62 of SEQ ID NO: 1380 (FIG. 20), IgA heavy chain sequence of BCR: base number 141 to base number 161 of SEQ ID NO: 1381 (FIG. 21), IgG heavy chain sequence of BCR: base number 163 to base number 183 of SEQ ID NO: 1382 (FIG. 22), IgD heavy chain sequence of BCR: base number 125 to base number 142 of SEQ ID NO: 1383 (FIG. 23), IgE heavy chain sequence of BCR: base number 155 to base number 173 of SEQ ID NO: 1384 (FIG. 24), Igκ chain constant region sequence of BCR: base number 103 to base number 120 of SEQ ID NO: 1385 (FIG. 25), Igλ chain sequence of BCR: base number 85 to base number 100 of SEQ ID NO: 1386 (FIG. 25).

As used herein, "second PCR amplification reaction" refers to a PCR amplification reaction performed in a nested form after the first PCR reaction by using a product of the first PCR reaction as a template in the sample production for analysis of the present invention. In the present invention, the amplification reaction is performed by using a common adaptor primer and a second TCR or BCR C region specific primer. In this regard, the second TCR or BCR C region specific primer is designed to have a sequence that is a complete match with the TCR or BCR C region in a sequence downstream the sequence of the first TCR or BCR C region specific primer, but comprise a sequence that is not homologous with other genetic sequences, and comprise a mismatching base between subtypes downstream when amplified.

As used herein "third PCR amplification reaction" is a PCR amplification reaction performed after a second nested PCR reaction by using a product of the second nested PCR reaction as a template in the sample production for analysis of the present invention, where a product thereof is used in the sample production for analysis of the present invention. A third PCR amplification reaction is performed, after the second nested PCR by using a product of a second nested PCR reaction as a template, by using an added common adaptor primer in which a nucleic acid sequence of the common adaptor primer comprises a first additional adaptor nucleic acid sequence, and an adaptor-added third TCR or BCR C region specific primer in which a second additional adaptor nucleic acid sequence and a molecule identification sequence (MID Tag sequence) are added to a third TCR or BCR C region specific sequence. An adaptor-added third TCR or BCR C region specific primer may comprise a sequence for verifying a nucleic acid sequence position called a key sequence. Specific example of the added common adaptor primer that can be used includes Adaptor B (SEQ ID NO: 1375)-TAATACGACTCCGAATTCCC, and specific examples of an adaptor-added third TCR or BCR C region specific primer that are used include Adaptor A (SEQ ID NO: 39)-key(TCAG)-MID1-(SEQ ID NO: 40) AAAGGGTTGGGGCGGATGC (SEQ ID NO: 1387) (entire primer is SEQ ID NO: 7), Adaptor A (SEQ ID NO: 39)-key(TCAG)-MID2 (SEQ ID NO: 41)-CCGCTTTCGCTCCAGGTCAC (SEQ ID NO: 1388) (entire primer is SEQ ID NO: 10), Adaptor A (SEQ ID NO: 39)-key(TCAG)-MID3 (SEQ ID NO: 42)-TGAGTTC-CACGACACCGTCAC (SEQ ID NO: 1389) (entire primer is SEQ ID NO: 13), Adaptor A (SEQ ID NO: 39)-key(TCAG)-MID4 (SEQ ID NO: 43)-CCCAGTTAT-CAAGCATGCC (SEQ ID NO: 1390) (entire sequence is SEQ ID NO: 16), Adaptor A (SEQ ID NO: 39)-key(TCAG)-MID5 (SEQ ID NO: 44)-CATTGGAGGGAATGTTTTTG (SEQ ID NO: 1391) (entire primer is SEQ ID NO: 19) and the like.

As used herein, "first additional adaptor nucleic acid sequence" is a sequence added to a primer used in the third PCR amplification reaction of the present invention, which is added to a nucleic acid sequence of a common adaptor primer for use. A first additional adaptor nucleic acid sequence may be different from or the same as a second additional adaptor nucleic acid sequence. As for the characteristic of such a sequence, such a nucleic acid sequence is a sequence suitable for bonding to a DNA capturing bead and an emPCR reaction (for example, see Chee-Seng, Ku; En Yun, Loy; Yudi, Pawitan; and Kee-Seng, Chia. Next Generation Sequencing Technologies and Their Applications. In: Encyclopedia of Life Sciences (ELS). John Wiley & Sons, Ltd: Chichester. April 2010; Metzker M L. Sequencing technologies—the next generation. Nat Rev Genet. 2010 January; 11(1): 31-46). Any sequence may be used as long as the sequence has such a characteristic. Specifically, CCTATCCCCTGTGTGCCTTGGCAGTC (SEQ ID NO: 1375) is used, but the sequence is not limited thereto.

As used herein, "second addition adaptor nucleic acid sequence" is a sequence added to a primer used in the third PCR amplification reaction of the present invention, wherein the sequence is optionally used with a molecule identifying sequence (e.g., (MID Tag sequence)) and/or a key sequence and is added to a third TCR or BCR C region specific sequence to constitute an adaptor-added third TCR or BCR C region specific primer. A second additional adaptor nucleic acid sequence may be different from or the same as a second additional adaptor nucleic acid sequence. As for the characteristic of such a sequence, such a nucleic acid sequence is a sequence suitable for an emPCR reaction, and any sequence may be used as long as the sequence has such a characteristic. Specifically, CCATCTCATCCCTGCGTGTCTCCGAC (SEQ ID NO: 39) is used, but the sequence is not limited thereto.

A "key sequence" as used herein is a sequence added to a primer used in the third PCR amplification reaction of the present invention, wherein the sequence is optionally used with a molecule identifying sequence (e.g., (MID Tag sequence)) and is added to a third TCR or BCR C region specific sequence to constitute an adaptor-added third TCR or BCR C region specific primer. Such a key sequence may be any sequence as long as a nucleic acid sequence position can be verified. A key sequence with 4 bases (TCAG) is used, but a key sequence is not limited thereto.

As used herein, "molecule identifying (MID Tag) sequence" is a sequence for imparting uniqueness such that an amplicon can be identified. Thus, it is preferably different from a sequence of interest. Further, it is preferably a sequence that does not affect amplification. Examples of such a sequence include, but are not limited to, sequences of SEQ ID NOs: 1325-1374. The baseline of determination for an identification sequence (tag sequence) and representative examples thereof are the following. Specifically, the baseline of determination of a tag sequence is explained as follows. A tag sequence is a base sequence added to distinguish each sample when a plurality of samples are mixed and simultaneously sequenced. A read from one sample corresponds to one tag sequence. Thus, it is possible to identify which sample is derived from an acquired read sequence. A tag sequence is any sequence of 4 types of bases A, C, G, and T. Theoretically, about a million types of sequences can be created with 10 bases and about a trillion types of sequences with 20 bases. The length of a base sequence is preferably between 2 and 40 bases, and more preferably between 6 and 10 bases. At the same time, it is desirable to use a sequence that is free of a consecutive sequence (AA, CC, GG, or TT). Representative tags that can be used herein are, but not limited to, the following: ACGAGTGCGT (SEQ ID NO: 1325), ACGCTCGACA (SEQ ID NO: 1326), AGACGCACTC (SEQ ID NO: 1327), AGCACTGTAG (SEQ ID NO: 1328), ATCAGACACG (SEQ ID NO: 1329), ATATCGCGAG (SEQ ID NO: 1330), CGTGTCTCTA (SEQ ID NO: 1331), CTCGCGTGTC (SEQ ID NO: 1332), TAGTATCAGC (SEQ ID NO: 1333), TCTCTATGCG (SEQ ID NO: 1334), TGATACGTCT (SEQ ID NO: 1335), TACTGAGCTA (SEQ ID NO: 1336), CATAGTAGTG (SEQ ID NO: 1337), CGAGAGATAC (SEQ ID NO: 1338), ATACGACGTA (SEQ ID NO: 1339), TCACGTACTA (SEQ ID NO: 1340), CGTCTAGTAC (SEQ ID NO: 1341), TCTACGTAGC (SEQ ID NO: 1342), TGTACTACTC (SEQ ID NO: 1343), ACGACTACAG (SEQ ID NO: 1344), CGTAGACTAG (SEQ ID NO: 1345), TACGAGTATG (SEQ ID NO: 1346), TACTCTCGTG (SEQ ID NO: 1347), TAGAGACGAG (SEQ ID NO: 1348), TCGTCGCTCG (SEQ ID NO: 1349), ACATACGCGT (SEQ ID NO: 1350), ACACGACGACT (SEQ ID NO: 1351), ACACGTAGTAT (SEQ ID NO: 1352), ACACTACTCGT (SEQ ID NO: 1353), ACGACACGTAT (SEQ ID NO: 1354), ACGAGTAGACT (SEQ ID NO: 1355), ACGCGTCTAGT (SEQ ID NO: 1356), ACGTACACACT (SEQ ID NO: 1357), ACGTACTGTGT (SEQ ID NO: 1358), ACGTAGATCGT (SEQ ID NO: 1359), ACTACGTCTCT (SEQ ID NO: 1360), ACTATACGAGT (SEQ ID NO: 1361), ACTCGCGTCGT (SEQ ID NO: 1362), AGTCGTGGTGT (SEQ ID NO: 1363), ATACTAGGTGT (SEQ ID NO: 1364), ACGAGTGGTGT (SEQ ID NO: 1365), ATACGTGGCGT (SEQ ID NO: 1366), AGTCTACGCGT (SEQ ID NO: 1367), ACTAGAGGCGT (SEQ ID NO: 1368), AGTGTGTGCGT (SEQ ID NO: 1369), ACACAGTGCGT (SEQ ID NO: 1370), ACGATCTGCGT (SEQ ID NO: 1371), AGAGACGGAGT (SEQ ID NO: 1372), ACTCGTAGAGT (SEQ ID NO: 1373), and ACGACGGGAGT (SEQ ID NO: 1374).

As used herein, "third TCR or BCR C region specific sequence" is a sequence specific to a C region of a TCR or a BCR, wherein the sequence is present more downstream of a first TCR or BCR C region specific sequence and a second TCR or BCR C region specific sequence. It is a sequence used for constituting a third TCR or BCR C region specific primer. Specific examples thereof include the sequence of a specific portion in CM3-GS (SEQ ID NO: 1387), sequence of a specific portion in CA3-GS (SEQ ID NO: 1388), sequence of a specific portion in CG3-GS (SEQ ID NO: 1389), sequence of a specific portion in CD3-GS (SEQ ID NO: 1390), and sequence in a specific portion in CE3-GS (SEQ ID NO: 1391) for BCRs, specific sequences in HuVaF or HuVbF in Table 6 (SEQ ID NOs: 40-60) for TCRs and the like (corresponding to base number 51 to base number 73 of SEQ ID NO: 1376 (FIG. 18); base number 69 to base number 91 of SEQ ID NO: 1377 (FIG. 18)). More specifically, such a primer sequence can be set in a specific range such as the following, but the sequence is not limited thereto. The first, second and third ranges can be set in the entire range, but can be mutually determined. That is, when the first is set, the second is downstream thereof, and the third is further downstream. Theoretically, it is understood that the primers only need to be downstream by the length of the primer.

α sequence of TCR: base number 51 to base number 73 of SEQ ID NO: 1376 (FIG. 18)

β sequence of TCR: base number 69 to base number 91 of SEQ ID NO: 1377 (FIG. 18)

γ sequence of TCR: base number 34 to base number 53 of SEQ ID NO: 1378 (FIG. 19)

δ sequence of TCR: base number 61 to base number 78 of SEQ ID NO: 1379 (FIG. 19)

IgM heavy chain sequence of BCR: base number 7 to base number 25 of SEQ ID NO: 1380 (FIG. 20)

IgA heavy chain sequence of BCR: base number 115 to base number 134 of SEQ ID NO: 1381 (FIG. 21)

IgG heavy chain sequence of BCR: base number 109 to base number 129 of SEQ ID NO: 1382 (FIG. 22)

IgD heavy chain sequence of BCR: base number 78 to base number 96 of SEQ ID NO: 1383 (FIG. 23)

IgE heavy chain sequence of BCR: base number 45 to base number 64 of SEQ ID NO: 1384 (FIG. 24)

Igκ chain constant region sequence of BCR: base number 75 to base number 92 of SEQ ID NO: 1385 (FIG. 25)

Igλ chain sequence of BCR: base number 52 to base number 69 of SEQ ID NO: 1386 (FIG. 25) (this SEQ ID NO is also used for CM).

As used herein, "third TCR or BCR C region specific primer" is a primer used in the third PCR amplification reaction of the present invention, which is designed to have a sequence that is a complete match with the TCR or BCR C region in a sequence downstream to the sequence of the second TCR or BCR C region specific primer, but comprise a sequence that is not homologous with other genetic sequences, and comprise a mismatching base between subtypes downstream when amplified. The primer further comprises an adaptor sequence, a key sequence, and an identification sequence. Specific examples thereof include, but are not limited to, CM3-GS (SEQ ID NO: 7), CA3-GS (SEQ ID NO: 10), CG3-GS (SEQ ID NO: 13), CD3-GS (SEQ ID NO: 16) and CE3-GS (SEQ ID NO: 19). Any sequence that can be set as a third TCR or BCR C region specific sequence mentioned above can be used.

As used herein, "isotype" refers to IgM, IgA, IgG, IgE, IgD or the like that belongs to the same type but have a difference sequence from one another. Isotypes can be denoted by using various abbreviations or symbols of genes.

As used herein, "subtype" is a type within a type present in IgA and IgG for BCRs. There are IgG1, IgG2, IgG3, and IgG4 for IgG and IgA1 and IgA2 for IgA. It is also known to be present in β and γ chains for TCRs, which are TRBC1 and TRBC2 and TRGC1 and TRGC2, respectively.

As used herein, "complete match" refers to 100% identity when sequences are compared to each other.

As used herein, "complete match with all C region allelic sequences of the same isotype" refers to a match with all sequences for C region allelic sequences of the same isotype when aligned. Since all sequences in a C region would never be identical even in the same isotype, use of a sequence that is a complete match with all C region allelic sequences of the same isotype would be advantageous for immediately determining an isotype when a sequence of an amplicon is determined.

As used herein, "unlikely to have a homodimer and intramolecular hairpin structures" refers to a state of a nucleic acid molecule, especially a common adaptor primer, where a sequence is unlikely to form a dimer due to pairing with a complementary strand or the like or is unlikely to form a hairpin structure or the like due to pairing with a complementary strand in a molecule. "Unlikely" allows for a degree of homodimer or hairpin that does not substantially affect the subsequent analysis, referring to, for example, tolerance of about 10% or less, 5% or less, 1% or less, 0.5% or less, 0.1% or less, 0.05% or less, or 0.01% or less of the whole. Such a sequence can be determined by using a known technology in the art (Santa Lucia, J. Proc Natl Acad Sci USA, 95 (4): 1460-1465. (1998), Bommarito et al., Nucleic Acids Res, 28 (9): 1929-1934. (2000), Santa Lucia, J. Proc Natl Acad Sci USA, 95 (4): 1460-1465. (1998), and von Ahsen et al., Clin Chem, 47 (11): 1956-1961. (2001)), for example, by a commercially available computer program or the like used in the Examples (CLC Main Workbench or Primer3).

As used herein, "not . . . have homodimer and intramolecular hairpin structures" refers to a state of a nucleic acid molecule, especially a common adaptor primer, where a sequence does not form a dimer due to pairing with a complementary strand or the like nor form a hairpin structure or the like due to pairing with a complementary strand in a molecule. Such a sequence can be determined by using a known technology in the art (Santa Lucia, J. Proc Natl Acad Sci USA, 95(4): 1460-1465. (1998), Bommarito et al., Nucleic Acids Res, 28 (9): 1929-1934. (2000), Santa Lucia, J. Proc Natl Acad Sci USA, 95 (4): 1460-1465. (1998), and von Ahsen et al., Clin Chem, 47 (11): 1956-1961. (2001)), for example, by a commercially available computer program or the like used in the Examples (CLC Main Workbench or Primer3).

As used herein, a structure that "can stably form a double strand" refers to a nucleic acid molecule, especially a common adaptor primer, where a double strand, when formed with another nucleic acid molecule such as a template, forms the strand stably. Such stability can be assessed mainly by temperature, pH, melting temperature (Tm) calculated from base composition, pHm or structure stabilizing energy ($-\Delta G_{37° C.}$). Such a sequence can be determined by using a known technology in the art (Santa Lucia, J. Proc Natl Acad Sci USA, 95(4): 1460-1465. (1998), Bommarito et al., Nucleic Acids Res, 28(9): 1929-1934. (2000), Santa Lucia, J. Proc Natl Acad Sci USA, 95(4): 1460-1465. (1998), and von Ahsen et al., Clin Chem, 47(11): 1956-1961. (2001)), for example, by a commercially available computer program or the like used in the Examples (CLC Main Workbench or Primer3).

As used herein, "not highly homologous" refers to a nucleic acid molecule, especially a common adaptor primer, with a feature of having homology that is not high with all the TCR genetic sequences in a database in order to enhance identifiability. For sufficient analysis, the level of homology is preferably, for example, 80% or less, 70% or less, 60% or less, 50% or less, 40% or less, 30% or less, 25% or less, 20% or less, 15% or less or 10% or less.

As used herein "same level of melting temperature (Tm)" refers to a DNA melting temperature (Tm) of a sequence or a primer to be used being substantially the same, which is a preferred condition for a suitable PCR amplification reaction. "Same level" may refer to Tm being ±15° C. or less, ±14° C. or less, ±13° C. or less, ±12° C. or less, ±11° C. or less, ±10° C. or less, ±9° C. or less, ±8° C. or less, ±7° C. or less, ±6° C. or less, ±5° C. or less, ±4° C. or less, ±3° C. or less, ±2° C. or less, ±1° C. or less, or ±0.5° C. or less. The Examples are able to carry out the present invention with a difference of 10.9° C. Thus, it is understood that about 15° C. or less is acceptable as the same level. Tm is a temperature at which 50% of a DNA molecule denatures to be a single strand. Tm can be identified with a known technology in the art. For example, Tm can be found as follows (a) for an oligonucleotide shorter than 18b: Tm=(A+T)×2° C.+(G+C)×4° C., (b) for an oligonucleotide with a length of 18 b or more: Tm=81.5+16.6 (log 10[Na+])+0.41 (% G+C)−(600/N), (*A: number of As in oligonucleotide, C: number of Cs in oligonucleotide, G: number of Gs in oligonucleotide, T: number of T in oligonucleotide, % G+C: % of G+C in oligonucleotide, N: length (mer) of oligonucleotide, [Na+]: Na+ concentration in solution (M)).

As used herein, "base length suitable for amplification" refers to a length of a primer or a sequence that is used, which is suitable for an amplification reaction. Such a length can be found, for example, by a commercially available computer program or the like used in the Examples (CLC Main Workbench or Primer3). The documents such as the following can also be referred: Santa Lucia, J. Proc Natl Acad Sci USA, 95 (4): 1460-1465. (1998), Bommarito et al., Nucleic Acids Res, 28 (9): 1929-1934. (2000), Santa Lucia, J. Proc Natl Acad Sci USA, 95 (4): 1460-1465. (1998), and von Ahsen et al., Clin Chem, 47 (11): 1956-1961. (2001).

As used herein, "mismatch" refers to the presence of bases that are not identical with each other when genetic sequences are aligned.

As used herein, "% GC (% guanine·cytosine content)" refers to the percentage of G (guanine), C (cytosine) in a nucleic acid sequence with respect to the entire base (including A (adenosine), T (thymine) and U (uracil)). High percentage thereof results in a higher melting temperature and is also related to gene density or band structure of chromosomes.

As used herein, "set compatible with all TCR or BCR subclasses" refers to primers prepared in accordance with the descriptions herein for all known subclasses (refers to TRBC1, TRBC2, or TRGC1, TRGC2 or the like for TCRs, or IgG1, IgG2, IgG3 or IgG4 for IgG, IgA1 or IgA2 for IgA or the like for BCRs) of a target TCR or BCR.

As used herein, "protein", "polypeptide", "oligopeptide" and "peptide" are used to have the same meaning and refer to an amino acid polymer of any length. Such a polymer may be a branched or straight chain or annular. An amino acid may be a natural or non-natural or altered amino acid. The term may also encompass those assembled into a complex of a plurality of polypeptide chains. The term also encompasses natural or artificially altered amino acid polymers. Examples of such an alteration include disulfide bond formation, glycosylation, lipidation, acetylation, phosphorylation or any other manipulation or alteration (e.g., conjugation with a labeling component). The definition also encompasses, for example, a polypeptide comprising one or more analogs of an amino acid (e.g., including a non-natural amino acid, etc.), peptide-like compound (e.g., peptoid), and other known alterations in the art.

As used herein, "amino acid" may be natural or non-natural as long as the objective of the present invention is met.

As used herein, "polynucleotide", "oligonucleotide" and "nucleic acid" are used in the same meaning and refer to a nucleotide polymer with any length. The term also encompasses "oligonucleotide derivative" and "polynucleotide derivative". "Oligonucleotide derivative" or "polynucleotide derivative" refers to an oligonucleotide or a polynucleotide, which has a bond between nucleotides that is not normal or includes a derivative of a nucleotide. They are interchangeably used. Specific examples of such an oligonucleotide include 2'-O-methyl-ribonucleotide, oligonucleotide derivative with a phosphodiester bond in an oligonucleotide converted to a phosphorothioate bond, oligonucleotide derivative with a phosphodiester bond in an oligonucleotide converted to an N3'—P5' phosphoroamidate bond, oligonucleotide derivative with a ribose and phosphodiester bond in an oligonucleotide converted to a peptide nucleic acid bond, oligonucleotide derivative with uracil in an oligonucleotide substituted with C-5 propynyl uracil, oligonucleotide derivative with uracil in an oligonucleotide substituted with C-5 thiazole uracil, oligonucleotide derivative with cytosine in an oligonucleotide substituted with C-5 propynyl cytosine, oligonucleotide derivative with cytosine in an oligonucleotide substituted with phenoxazine-modified cytosine, oligonucleotide derivative with ribose in a DNA substituted with 2'-O-propylribose, oligonucleotide derivative with ribose in an oligonucleotide substituted with 2'-methoxyethoxyribose and the like. Unless specifically noted otherwise, a specific nucleic acid sequence is further intended to encompass conservatively altered variants (e.g., degenerate codon substituted form) and complementary sequences thereof in addition to the explicitly shown sequences. Specifically, a degenerate codon substituted form can be obtained by creating a sequence in which the third position of one or more selected (or all) codons is substituted with a mixed base and/or deoxyinosine residue (Batzer et al., Nucleic Acid Res. 19: 5081 (1991); Ohtsuka et al., J. Biol. Chem. 260: 2605-2608 (1985); Rossolini et al., Mol. Cell. Probes 8: 91-98 (1994)). As used herein, "nucleic acid" is interchangeably used with gene, cDNA, mRNA, oligonucleotide, and polynucleotide. As used herein, "nucleotide" may be natural or non-natural.

As used herein, "gene" refers to an agent defining a genotype. A gene is generally arranged in a certain order in a chromosome. A gene defining the primary structure of a protein is referred to as a structural gene, and a gene affecting the expression thereof is referred to as a regulator gene. As used herein, "gene" may refer to a "polynucleotide", "oligonucleotide" or "nucleic acid". "Gene product" is a substance produced based on a gene and refers to a protein, mRNA or the like.

As used herein, "homology" of genes refers to the level of identity of two or more genetic sequences to one another. In general, having "homology" refers to having a high level of identity or similarity. Thus, a higher level of homology of two genes results in a higher level of identity or similarity of sequences thereof. It is possible to examine whether two types of genes are homologous by direct comparison of sequences or by hybridization under stringent conditions for nucleic acids. When directly comparing two genetic sequences, the genes are homologous typically when DNA sequences between the genetic sequences are at least 50% identical, preferably at least 70% identical, and more preferably at least 80%, 90%, 95%, 96%, 97%, 98% or 99% identical. Thus, as used herein, "homolog" or "homologous gene product" refers to a protein in another species, preferably a mammal, which exerts the same biological function as a protein constituent element of a complex further described herein.

An amino acid may be mentioned herein by a commonly known three letter symbol thereof or a one letter symbol recommended by IUPAC-IUB Biochemical Nomenclature Commission. Similarly, a nucleotide may be mentioned by a commonly recognized one letter code. Herein, comparison of similarity, identity and homology of amino acid sequences and base sequences is calculated by using a default parameter with a sequence analysis tool BLAST. For instance, identity can be searched by using NCBI's BLAST 2.2.9 (published on 5 Dec. 2004). The value of identity herein generally refers to a value from using the above-described BLAST to align sequences under default conditions. However, when a higher value is output by changing a parameter, the highest value is considered the value of identity. When identity is assessed in a plurality of regions, the highest value thereamong is considered the value of identity. Similarity is a numerical value that uses a similar amino acid for the calculation in addition to identity.

As used herein, "polynucleotide that hybridizes under stringent conditions" refers to a conventional, well-known condition in the art. Such a polynucleotide can be obtained by using colony hybridization, plaque hybridization, southern blot hybridization or the like while using a polynucleotide selected from the polynucleotides of the present invention as a probe. Specifically, such a polynucleotide refers to a polynucleotide which can be identified by using a filter with immobilized DNA derived from a colony or a plaque for hybridization at 65° C. in the presence of 0.7-1.0 M NaCl, and then using a 0.1 to 2-fold concentration SSC (saline-sodium citrate) solution (composition of an SSC solution with 1-fold concentration is 150 mM sodium chloride and 15 mM sodium citrate) to wash the filter under the condition of 65° C. Hybridization can be performed in accordance with the method described in experimental publications such as Molecular Cloning 2$^{nd}$ ed., Current Protocols in Molecular Biology, Supplement 1-38, DNA Cloning 1: Core Techniques, A Practical Approach, Second Edition, Oxford University Press (1995). In this regard, a sequence comprising only an A sequence or only a T sequence is preferably excluded from a sequence that hybridizes under stringent conditions. Thus, the polypeptide used in the present invention (e.g., transthyretin and the like) encompasses polypeptides encoded by a nucleic acid molecule that hybridizes under stringent conditions to a nucleic acid molecule encoding a polypeptide particularly described in the present invention. The low stringency conditions include hybridization for 18-hours at 40° C. in a buffer solution comprising 35% formamide, 5×SSC, 50 mM Tris-HCl (pH 7.5), 5 mM EDTA, 0.02% polyvinylpyrrolidone (PVP), 0.02% BSA, 100 μg/ml denatured salmon sperm DNA, and 10% (w/v) dextran sulfate, washing for 1-5 hours at 55° C. in a buffer solution consisting of 2×SSC, 25 mM Tris-HCl (pH 7.4), 5 mM EDTA, and 0.1% SDS, and washing for 1.5 hours at 60° C. in a buffer solution consisting of 2×SSC, 25 mM Tris-HCl (pH 7.4), 5 mM EDTA, and 0.1% SDS.

As used herein, "purified" substance or biological agent (e.g., nucleic acid, protein or the like) refers to a biological agent having at least some of the agents that are naturally accompanied therewith removed. Thus, purity of a biological agent in a purified biological agent is generally higher than that of a normal condition of the biological agent (i.e., concentrated). The term "purified" as used herein preferably refers to the presence of at least 75 wt. %, more preferably at least 85 wt. %, still more preferably at least 95 wt. %, and the most preferably at least 98 wt. % of biological agents of the same type. A substance used in the present invention is preferably a "purified" substance.

As used herein, "corresponding" amino acid or nucleic acid" refers to an amino acid or nucleotide which has, or is expected to have, action similar to a determined amino acid or nucleotide in a polypeptide or polynucleotide that is a baseline of comparison in a certain polypeptide molecule or polynucleotide molecule, and particularly for an enzyme molecule refers to an amino acid that is at the same position in an active site and provides the same contribution to catalytic activity. For instance, for antisense molecules, this may be a similar portion in an ortholog corresponding to a specific portion of the antisense molecule. A corresponding amino acid may be a specific amino acid that has undergone cysteinylation, glutathionylation S—S bond formation, oxidation (e.g., oxidation of methionine side chain), formylation, acetylation, phosphorylation, glycosylation, myristylation or the like. Alternatively, a corresponding amino acid may be an amino acid responsible for dimerization. Such a "corresponding" amino acid or nucleic acid may be a region or domain (e.g., V region, D region or the like) over a certain range. Thus, such a region or domain is called a "corresponding" region or domain herein.

As used herein, "fragment" refers to a polypeptide or polynucleotide with a sequence length of 1 to n−1 with respect to the full length polypeptide or polynucleotide (with length n). The length of a fragment can be appropriately changed in accordance with the objective. Examples of the lower limit of such a length include 3, 4, 5, 6, 7, 8, 9, 10, 15, 20, 25, 30, 40, 50 and more amino acids for a polypeptide. Lengths represented by an integer that is not specifically listed herein (e.g., 11 and the like) also can be suitable as a lower limit. Further, examples of length include 5, 6, 7, 8, 9, 10, 15, 20, 25, 30, 40, 50, 75, 100, and more nucleotides for a polynucleotide. Lengths represented by an integer that is not specifically listed herein (e.g., 11 and the like) also can be suitable as a lower limit. As used herein, such a fragment is understood to be within the scope of the present invention when a full length version functions as a marker, as along as the fragment itself also functions as a marker.

The term "activity" according to the present invention refers to a function of a molecule in the broadest sense herein. Activity, although not intended to be limiting, generally includes a biological function, biochemical function, physical function, therapeutic activity, diagnostic activity and chemical function of a molecule. Examples of activity include enzymatic activity, an ability to interact with another molecule, an ability to activate, promote, stabilize, inhibit, suppress, or destabilize a function of another molecule, stability, and ability to localize at a specific position in a cell. When applicable, the term also relates to a function of a protein complex in the broadest sense.

As used herein "expression" of a gene, polynucleotide, polypeptide or the like refers to the gene or the like being affected by a certain action in vivo to have another form. Preferably, expression refers to a gene, polynucleotide or the like being transcribed and translated to be in a form of a polypeptide, but being transcribed to make an mRNA can also be one form of expression. More preferably, such a polypeptide form can be those processed after translation (derivative as referred to herein).

A functional equivalent such as an isotype of a molecule such as IgG used in the present invention can be found by searching a database or the like. As used herein, "search" refers to utilizing a certain nucleic acid base sequence electronically, biologically, or by another method, preferably electronically, to find another nucleic acid base sequence having a specific function and/or property. Examples of electronic search include, but are not limited to, BLAST (Altschul et al., J. Mol. Biol. 215: 403-410 (1990)), FASTA (Pearson & Lipman, Proc. Natl. Acad. Sci., USA 85: 2444-2448 (1988)), Smith and Waterman method (Smith and Waterman, J. Mol. Biol. 147: 195-197 (1981)), Needleman and Wunsch method (Needleman and Wunsch, J. Mol. Biol. 48: 443-453 (1970)) and the like. BLAST is typically used. Examples of biological search include, but are not limited to, stringent hybridization, a macroarray with a genomic DNA applied to a nylon membrane or the like or a microarray with a genomic DNA applied to a glass plate (microarray assay), PCR, in situ hybridization and the like. Herein, a gene used in the present invention is intended to include corresponding genes identified by such electronic search or biological search.

As a functional equivalent of the present invention, it is possible to use an amino acid sequence with one or more amino acid insertions, substitutions or deletions, or addition to one or both ends. As used herein, "one or more amino acid insertions, substitutions or deletions, or addition to one or both ends" in an amino acid sequence refers to an alteration with a substitution of multiple amino acids or the like to the extent that can occur naturally by a well-known technical method such as site-directed mutagenesis or a natural mutation. An altered amino acid sequence of a molecule can have, for example, 1-30, preferably 1-20, more preferably 1-9, still more preferably 1-5, and especially preferably 1-2 amino acid insertion, substitution or deletion or addition to one or both ends. An altered amino acid sequence may be an amino acid sequence having one or more (preferably 1 or several, or 1, 2, 3 or 4) conservative substitutions in an amino acid sequence of a molecule such as CD98. "Conservative substitution" refers to a substitution of one or more amino acid residues with another chemically similar amino acid residue so as not to substantially alter a function of a protein. Examples thereof include cases where a hydrophobic residue is substituted with another hydrophobic residue, cases where a polar residue is substituted with another polar residue having the same charge and the like. Functionally similar amino acids that can be substituted in this manner are known in the art for each amino acid. Specific examples include alanine, valine, isoleucine, leucine, proline, tryptophan, phenylalanine, methionine and the like for nonpolar (hydrophobic) amino acids, glycine, serine, threonine, tyrosine, glutamine, asparagine, cysteine and the like for polar (neutral) amino acids. Examples of positively charged (basic) amino acid include arginine, histidine, lysine and the like. Further, examples of a negatively-charged (acidic) amino acid include aspartic acid, glutamic acid and the like.

As used herein, "marker (substance, protein or gene (nucleic acid))" refers to a substance that can be an indicator for tracking whether a target is in or in risk of being in a certain condition (e.g., normal cell state, transformed state, diseased state, disorder state, level of or presence of proliferation capability or differentiated state or the like). Examples of such a marker include genes (nucleic acid=DNA level), gene products (mRNA, protein, and the like), metabolites, enzymes and the like. In the present invention, detection, diagnosis, preliminary detection, prediction or prediagnosis of a certain state (e.g., disease such as differentiation disorder) can be materialized by using an agent or means specific to a marker associated with such a state, or a composition, kit or system comprising the same or the like. As used herein, "gene product" refers to a protein or mRNA encoded by a gene.

As used herein, "subject" refers to a target subjected to diagnosis, detection or the like of the present invention (e.g., an organism such as a human or an organ or cell extracted from an organism or the like).

As used herein, "sample" refers to any substance obtained from a subject or the like. For example, an eye cell and the like are encompassed. Those skilled in the art can appropriately select a preferred sample based on the descriptions herein.

As used herein, "agent" is used broadly and may be any substance or other elements (e.g., energy, radiation, heat, electricity and other forms of energy) as long as the intended objective can be achieved. Examples of such a substance include, but are not limited to, protein, polypeptide, oligopeptide, peptide, polynucleotide, oligonucleotide, nucleotide, nucleic acid (including for example DNAs such as cDNA and genomic DNA, RNAs such as mRNA), polysaccharide, oligosaccharide, lipid, organic small molecule (e.g., hormone, ligand, information transmitting substance, organic small molecule, molecule synthesized by combinatorial chemistry, small molecule that can be used as medicine (e.g., small molecule ligand and the like) and a composite molecule thereof). Typical examples of an agent specific to a polynucleotide include, but are not limited to, a polynucleotide having complementarity with a certain sequence homology (e.g., 70% or greater sequence identity) to a sequence of the polynucleotide, polypeptide such as a transcription factor that binds to a promoter region and the like. Typical examples of an agent specific to a polypeptide include, but are not limited to, an antibody directed specifically to the polypeptide or a derivative or analog thereof (e.g., single strand antibody), a specific ligand or receptor when the polypeptide is a receptor or ligand, a substrate when the polypeptide is an enzyme and the like.

As used herein, "detecting agent" broadly refers to all agents capable of detecting a target of interest.

As used herein, "diagnostic agent" broadly refers to all agents capable of diagnosing a condition of interest (e.g., disease or the like).

The detecting agent of the present invention may be a complex or composite molecule in which another substance (e.g., label or the like) is bound to a portion enabling detection (e.g., antibody or the like). As used herein, "complex" or "composite molecule" refers to any construct comprising two or more portions. For instance, when one portion is a polypeptide, the other portion may be a polypeptide or other substances (e.g., sugar, lipid, nucleic acid, other carbohydrate or the like). As used herein, two or more constituent portions of a complex may be bound by a covalent bond or any other bond (e.g., hydrogen bond, ionic bond, hydrophobic interaction, Van der Waals force or the like). When two or more portions are polypeptides, the complex may be called a chimeric polypeptide. Thus, "complex" as used herein includes molecules formed by linking a plurality of types of molecules such as a polypeptide, polynucleotide, lipid, sugar, or small molecule.

As used herein, "interaction" refers, for two substances, to applying a force (e.g., intermolecular force (Van der Waals force), hydrogen bond, hydrophobic interaction, or the like) between one substance and the other substance. Generally, two substances that have interacted are in a conjugated or bound state.

As used herein, the term "bond" refers to a physical or chemical interaction between two substances or between combinations thereof. A bond includes an ionic bond, nonionic bond, hydrogen bond, Van der Waals bond, hydrophobic interaction and the like. A physical interaction (bond) may be direct or indirect. Indirect physical interaction (bond) is mediated by or is due to an effect of another protein or compound. A direct bond refers to an interaction, which does not occur through or due to an effect of another protein or compound and does not substantially involve another intermediate. The degree of expression of the marker of the present invention or the like can be measured by measuring a bond or interaction.

Thus, an "agent" (or detecting agent or the like) that "specifically" interacts (or binds) to a biological agent such as a polynucleotide or a polypeptide as used herein encompasses agents with affinity to the biological agent such as a polynucleotide or polypeptide that is typically similar or higher, preferably significantly (e.g., statistically significantly) higher, than affinity to other unrelated polynucleotide or polypeptide (especially those with less than 30% identity). Such affinity can be measured by, for example, hybridization assay, binding assay or the like.

As used herein, "specific" interaction (or bond) of a first substance or agent with a second substance or agent refers to the first substance or agent interacting with (or binding to) the second substance or agent at a higher level of affinity than to substances or agents other than the second substance or agent (especially other substances or agents in a sample comprising the second substance or agent). Examples of an interaction (or bond) specific to a substance or agent include, but are not limited to, a ligand-receptor reaction, hybridization in a nucleic acid, antigen-antibody reaction in a protein, enzyme-substrate reaction and the like, and when both a nucleic acid and a protein are involved, a reaction between a transcription factor and a binding site of the transcription factor and the like, protein-lipid interaction, nucleic acid-lipid interaction and the like. Thus, when substances or agents are both nucleic acids, a first substance or agent "specifically interacting" with a second substance or agent encompasses the first substance or agent having at least partial complementarity to the second substance or agent. Further, examples of a first substance or agent "specifically" interacting with (or binding to) a second substance or agent when substances or agents are both proteins includes, but are not limited to, interaction by an antigen-antibody reaction, interaction by a receptor-ligand reaction, enzyme-substrate interaction and the like. When two types of substances or agents include a protein and a nucleic acid, a first substance or agent "specifically" interacting with (or binding to) a second substance or factor encompasses an interaction (or a bond) between a transcription factor and a binding region of a nucleic acid molecule targeted by the transcription factor.

As used herein, "detection" or "quantification" of polynucleotide or polypeptide expression can be accomplished by using a suitable method including, for example, an immunological measuring method and measurement of mRNAs, including a bond or interaction to a marker detecting agent. However, measurement can be performed with the amount of PCR product in the present invention. Examples of a molecular biological measuring method include northern blot, dot blot, PCR and the like. Examples of an immunological measurement method include ELISA using a microtiter plate, RIA, fluorescent antibody method, luminescence immunoassay (LIA), immunoprecipitation (IP), single radial immunodiffusion (SRID), turbidimetric immunoassay (TIA), western blot, immunohistochemical staining and the like. Further, examples of a quantification method include ELISA, RIA and the like. Quantification may also be performed by a gene analysis method using an array (e.g., DNA array, protein array). DNA arrays are outlined extensively in (Ed. by Shujunsha, Saibo Kogaku Bessatsu "DNA Maikuroarei to Saishin PCR ho" [Cellular engineering, Extra issue, "DNA Microarrays and Latest PCR Methods"]. Protein arrays are discussed in detail in Nat Genet. 2002 December; 32 Suppl: 526-32. Examples of a method of analyzing gene expression include, but are not limited to, RT-PCR, RACE, SSCP, immunoprecipitation, two-hybrid system, in vitro translation and the like, in addition to the methods discussed above. Such additional analysis methods are described in, for example, Genomu Kaiseki Jikkenho Nakamura Yusuke Labo Manyuaru [Genome analysis experimental method Yusuke Nakamura Lab Manual], Ed. by Yusuke Nakamura, Yodosha (2002) and the like. The entirety of the descriptions therein is incorporated herein by reference.

As used herein, "amount of expression" refers to the amount of polypeptide, mRNA or the like expressed in a cell, tissue or the like of interest. Examples of such an amount of expression include amount of expression of polypeptide of the present invention at a protein level assessed by any suitable method including an immunological measurement method such as ELISA, RIA, fluorescent antibody method, western blot, and immunohistochemical staining by using the antibody of the present invention, and the amount of expression of the polypeptide used in the present invention at an mRNA level assessed by any suitable method including a molecular biological measuring method such as northern blot, dot blot, and PCR. "Change in amount of expression" refers to an increase or decrease in the amount of expression of the polypeptide used in the present invention at a protein level or mRNA level assessed by any suitable method including the above-described immunological measuring method or molecular biological measuring method. A variety of detection or diagnosis based on a marker can be performed by measuring the amount of expression of a certain marker.

As used herein, "decrease" or "suppression" of activity or expression product (e.g., protein, transcript (RNA or the like)) or synonyms thereof refers to: a decrease in the amount, quality or effect of a specific activity, transcript or protein; or activity that decreases the same.

As used herein, "increase" or "activation" of activity or expression product (e.g., protein, transcript (RNA or the like)) or synonyms thereof refers to: an increase in the amount, quality or effect of a specific activity, transcript or protein; or activity that increases the same.

Thus, it is understood that activity of an immune system can be detected or screened by using a regulatory ability such as decrease, suppression, increase or activation of the marker of the present invention as an indicator.

As used herein, "means" refers to anything that can be a tool for accomplishing an objective (e.g., detection, diagnosis, therapy). In particular, "means for selective recognition (detection)" as used herein refers to means capable of recognizing (detecting) a certain subject differently from others.

The present invention is useful as an indicator of an immune system condition. Thus, the present invention can be used to identify an indicator of an immune system condition and know the condition of a disease.

As used herein, "(nucleic acid) primer" refers to a substance required for initiating a reaction of a polymeric compound to be synthesized in a polymer synthesizing enzyme reaction. A synthetic reaction of a nucleic acid molecule can use a nucleic acid molecule (e.g., DNA, RNA or the like) complementary to a portion of a sequence of a polymeric compound to be synthesized. A primer can be used herein as a marker detecting means.

Examples of a nucleic acid molecule generally used as a primer include those having a nucleic acid sequence with a length of at least 8 contiguous nucleotides, which is complementary to a nucleic acid sequence of a gene of interest (e.g., marker of the present invention). Such a nucleic acid sequence may be a nucleic acid sequence with a length of preferably at least 9 contiguous nucleotides, more preferably at least 10 contiguous nucleotides, still more preferably at least 11 contiguous nucleotides, at least 12 contiguous nucleotides, at least 13 contiguous nucleotides, at least 14 contiguous nucleotides, at least contiguous nucleotides, at least 16 contiguous nucleotides, at least 17 contiguous nucleotides, at least contiguous nucleotides, at least 19 contiguous nucleotides, at least 20 contiguous nucleotides, at least contiguous nucleotides, at least 30 contiguous nucleotides, at least 40 contiguous nucleotides, or at least 50 contiguous nucleotides. A nucleic acid sequence used as a probe comprises a nucleic acid sequence that is at least 70% homologous, more preferably at least 80% homologous, still more preferably at least 90% homologous, or at least 95% homologous to the aforementioned sequence. A sequence suitable as a primer may vary depending on the property of a sequence intended for synthesis (amplification). However, those skilled in the art are capable of designing an appropriately primer in accordance with an intended sequence. Design of such a primer is well known in the art, which may be performed manually or by using a computer program (e.g., LASERGENE, PrimerSelect, or DNAStar).

The primers according to the present invention can be used as a primer set consisting of two or more types of the primers.

The primers and primer set according to the present invention can be used as primers and primer set in accordance with a common method in a known method of detecting a gene of interest by utilizing a nucleic acid amplification method such as PCR, RT-PCR, real-time PCR, in situ PCR, or LAMP.

The primer set according to the present invention can be selected such that a nucleotide sequence of a protein of interest such as a molecule of a T cell receptor can be amplified by a nucleic acid amplification method such as PCR. Nucleic acid amplification methods are well known. Selection of a primer pair in a nucleic acid amplification method is evident to those skilled in the art. For instance, primers can be selected in PCR such that one of the two primers (primer pair) is paired with the plus strand of a double-stranded DNA of a protein of interest such as a T cell receptor molecule while the other primer is paired with the minus strand of the double-stranded DNA and the chain extended by one of the primers is paired with the other primer. The primer of the present invention can be chemically synthesized based on the nucleotide sequence disclosed herein. Preparation of a primer is well known and can be carried out in accordance with, for example, "Molecular Cloning, A Laboratory Manual $2^{nd}$ ed." (Cold Spring Harbor Press (1989)), "Current Protocols in Molecular Biology" (John Wiley & Sons (1987-1997)).

As used herein, "probe" refers to a substance that can be means for search, which is used in a biological experiment such as in vitro and/or in vivo screening. Examples thereof include, but are not limited to, a nucleic acid molecule comprising a specific base sequence, a peptide comprising a specific amino acid sequence, a specific antibody, a fragment thereof and the like. As used herein, a probe can be used as marker detecting means.

A nucleic acid molecule generally used as a probe includes those having a nucleic acid sequence with a length of at least 8 contiguous nucleotides, which is homologous or complementary to a nucleic acid sequence of a gene of interest. Such a nucleic acid sequence may be a nucleic acid sequence with a length of preferably at least 9 contiguous nucleotides, more preferably at least 10 contiguous nucleotides, still more preferably at least 11 contiguous nucleotides, at least 12 contiguous nucleotides, at least 13 contiguous nucleotides, at least 14 contiguous nucleotides, at least 15 contiguous nucleotides, at least contiguous nucleotides, at least 25 contiguous nucleotides, at least 30 contiguous nucleotides, at least contiguous nucleotides, or at least 50 contiguous nucleotides. A nucleic acid sequence used as a probe comprises a nucleic acid sequence that is at least about 70% homologous, more preferably at least about 80% homologous, still more preferably at least about 90% homologous, or at least about 95% homologous with the aforementioned sequence.

In one embodiment, the detecting agent of the present invention may be labeled. Alternatively, the detecting agent of the present invention may be bound to a tag.

As used herein, "label" refers to an entity (e.g., substance, energy, electromagnetic wave or the like) for distinguishing a molecule or substance of interest from others. Such a method of labeling includes RI (radioisotope) method, fluorescence method, biotin method, chemiluminescent method and the like. When a plurality of markers of the present invention or agents or means for capturing the same are labeled by a fluorescence method, labeling is performed with labeling substances having different fluorescent emission maximum wavelengths. It is preferable that the difference in fluorescent emission maximum wavelengths is 10 nm or greater. When labeling a ligand, any label that does not affect the function can be used. However, Alexa™ Fluor is desirable as a fluorescent substance. Alexa™ Fluor is a water-soluble fluorescent dye obtained by modifying coumarin, rhodamine, fluorescein, cyanine or the like. This is a series compatible with a wide range of fluorescence wavelengths. Relative to other fluorescent dyes for the corresponding wavelength, Alexa™ Fluor is very stable, bright and has a low level of pH sensitivity. Combinations of fluorescent dyes with fluorescence maximum wavelength of 10 nm or greater include a combination of Alexa™ 555 and Alexa™ 633, combination of Alexa™ 488 and Alexa™ 555 and the like. When a nucleic acid is labeled, any substance can be used that can bind to a base portion thereof. However, it is preferable to use a cyanine dye (e.g., Cy3, Cy5 or the like of the CyDye™ series), rhodamine 6G reagent, N-acetoxy-N2-acetylaminofluorene (AAF), AAIF (iodine derivative of AAF) or the like. Examples of a fluorescent substance with a difference in fluorescent emission maximum wavelengths of nm or greater include a combination of Cy5 and a rhodamine 6G reagent, a combination of Cy3 and fluorescein, a combination of a rhodamine 6G reagent and fluorescein and the like. The present invention can utilize such a label to alter a subject of interest to be detectable by the detecting means to be used. Such alteration is known in the art. Those skilled in the art can appropriately carry out such a method in accordance with the label and subject of interest.

As used herein, "tag" refers to a substance for distinguishing a molecule by a specific recognition mechanism such as receptor-ligand, or more specifically, a substance serving the role of a binding partner for binding a specific substance (e.g., having a relationship such as biotin-avidin or biotin-streptavidin). A tag can be encompassed in the scope of "label". Accordingly, a specific substance to which a tag is bound can distinguish the specific substance by a contact with a substrate, to which a binding partner of a tag sequence is bound. Such a tag or label is well known in the art. Typical tag sequences include, but are not limited to, myc tag, His tag, HA, Avi tag and the like. Such a tag may be bound to the marker or marker detecting agent of the present invention.

In this regard, "test sample" only needs to be a cell of interest or a substance derived therefrom, which is considered to comprise an element enabling gene expression.

As used herein, "diagnosis" refers to identifying various parameters associated with a disease, disorder, condition or the like in a subject to determine the current or future state of such a disease, disorder, or condition. The condition in the body can be examined by using the method, apparatus, or system of the present invention. Such information can be used to select and determine various parameters of a formulation or method for treatment or prevention to be administered, disease, disorder, or condition in a subject or the like. As used herein, "diagnosis" when narrowly defined refers to diagnosis of the current state, but when broadly defined includes "early diagnosis", "predictive diagnosis", "prediagnosis" and the like. Since the diagnostic method of the present invention in principle can utilize what comes out from a body and can be conducted away from a medical practitioner such as a physician, the present invention is industrially useful. In order to clarify that the method can be conducted away from a medical practitioner such as a physician, the term as used herein may be particularly called "assisting" "predictive diagnosis, prediagnosis or diagnosis".

The formulation procedure for a diagnostic agent or the like of the present invention as a medicament or the like is known in the art. The procedure is described, for example, in Japanese Pharmacopoeia, the United States Pharmacopeia, pharmacopeia of other countries, or the like. Thus, those skilled in the art can determine the amount to be used without undue experimentation from the descriptions herein.

As used herein, "complete match with all C region allelic sequences of the same isotype" refers to a match with all sequences for C region allelic sequences of the same isotype when aligned. Since all sequences in a C region would never be identical even in the same isotype, use of a sequence that is a complete match with all C region allelic sequences of the same isotype would be advantageous for immediately determining an isotype when a sequence of an amplicon is determined.

As used herein, "trimming" refers to removal of an unsuitable portion in gene analysis. Trimming is performed by removing low quality regions from both ends of a read, partial sequence of an artificial nucleic acid sequence imparted in an experimental procedure, or both. Trimming can be performed with a software known in the art or by referring to references (for example, cutadapt hypertext transfer protocol colon journal dot embnet dot org/index dot php/embnetjournal/article/view/200/ (EMBnet dot-journal, 2011); fastq-mcf Aronesty E., The Open BioinformaticsJournal (2013) 7, 1-8 (DOI: 10.2174/1875036201307010001); and fastx-toolkit hypertext transfer protocol colon hannonlab dot-cshl dot-edu/fastx toolkit/ (2009)). For an adaptor sequence or an artificial nucleic acid sequence, trimming is preferably accomplished by the steps of: deleting low quality regions from both ends of a read; deleting a region matching 10 bp or more with an adaptor sequence from both ends of the read; and using the read as a high quality read in analysis when the remaining length is 200 bp or more (TCR) or 300 bp or more (BCR).

As used herein, "suitable length" refers to a length that is adapted to analysis when analysis of an alignment or the like is performed in the gene analysis of the present invention. For example, such a length can be determined to be a length including 100 bases toward a D region on a V region from a sequencing initiation position on a C region. In the present invention, examples of a suitable length include, but are not limited to, 200 nucleotides or longer, preferably 250 nucleotides or longer for TCRs and 300 nucleotides or longer and preferably 350 nucleotides or longer for BCRs.

As used herein, "input sequence set" refers to a set of target sequences of TCR or BCR repertoire analysis in the gene analysis of the present invention.

As used herein, "gene region" refers to each of V region, D region, J region, C region and the like. Such gene regions are known in the art and can be appropriately determined by referring to a database or the like. As used herein, "homology" of genes refers to the level of identity of 2 or more genetic sequences to one another. In general, having "homology" refers to having a high level of identity or similarity. Thus, a higher level of homology of two genes results in a higher level of identity or similarity of sequences thereof. It is possible to examine whether two types of genes are homologous by direct comparison of sequences or by hybridization under stringent conditions for nucleic acids. As used herein, "homology search" refers to search for homology. Preferably, homology can be searched in silico by using a computer.

As used herein, "approximate" refers to having a high level of homology when homology search is performed. A software for homology search (BLAST, FASTA or the like), when executed, generally lists results in order of high level of homology. Thus, approximation is possible by appropriately selecting a result that is highly ranked.

As used herein, "closest" refers to the highest level of homology when homology search is performed. When homology is searched with a software, the result displayed as ranking number one is selected.

As used herein, "reference allele" refers to a reference allele that results in a match in a reference database when homology search is performed.

As used herein, "alignment" (or align) in bioinformatics refers to similar regions of a primary structure of a biomolecule such as DNA, RNA, or protein arranged in alignment to be identifiable or the act of arranging. Alignment can provide a clue for understanding the functional, structural, or evolutionary relationship of sequences.

As used herein, "assign" refers to allocating specific information such as a gene name, function, characteristic region (e.g., V region, J region or the like) to a certain sequence (e.g., nucleic acid sequence, protein sequence or the like). Specifically, this is accomplished by inputting or linking specific information to a certain sequence or the like.

As used herein, "CDR3" refers to the third complementarity-determining region (CDR). In this regard, CDR is a region that directly contacts an antigen and undergoes a particularly large change among variable regions, and is referred to as a hypervariable region. Each variable region of a light chain and a heavy chain has three CDRs (CDR1-CDR3) and 4 FRs (FR1-FR4) surrounding the three CDRs. Since a CDR3 region is considered to be present across V region, D region and J region, it is considered as an important key for a variable region, and is thus used as a subject of analysis.

As used herein, "front of CDR3 on a reference V region" refers to a sequence corresponding to the front of CDR3 in a V region targeted by the present invention.

As used herein, "end of CDR3 on a reference J" refers to a sequence corresponding to the end of CDR3 in a J region targeted by the present invention.

As used herein, "condition tolerating random mutations to be scattered throughout" refers to any condition which results in random mutations being scattered around. For example, such a condition is often expressed by the following condition for BLAST/FASTA optimal parameters: tolerates a maximum mismatch of 33% across the full length of an alignment; and tolerates a maximum nonconsecutive mismatch of 60% for any 30 bp therein. A functional equivalent such as an isotype of a molecule, e.g. IgG, used in the present invention can be found by searching a database or the like. As used herein, "search" refers to utilizing a certain nucleic acid base sequence electronically, biologically, or by another method, preferably electronically, to find another nucleic acid base sequence having a specific function and/or property. Examples of electronic search include, but are not limited to, BLAST (Altschul et al., J. Mol. Biol. 215: 403-410 (1990)), FASTA (Pearson & Lipman, Proc. Natl. Acad. Sci., USA 85: 2444-2448 (1988)), Smith and Waterman method (Smith and Waterman, J. Mol. Biol. 147: 195-197 (1981)), Needleman and Wunsch method (Needleman and Wunsch, J. Mol. Biol. 48: 443-453 (1970)) and the like. BLAST is typically used. Examples of biological search include, but are not limited to, stringent hybridization, a macroarray with a genomic DNA applied to a nylon membrane or the like or a microarray with a genomic DNA applied to a glass plate (microarray assay), PCR, in situ hybridization and the like. Herein, a gene used in the present invention is intended to include corresponding genes identified by such electronic search or biological search.

(Preferred Embodiments)

Preferred embodiments of the present invention are described below. The embodiments are provided for better understanding of the present invention. It is understood that the scope of the present invention should not be limited to the following descriptions. Further, it is apparent that those skilled in the art can readily make modifications within the scope of the present invention while referring to the descriptions herein. For such embodiments, those skilled in the art can appropriately combine any embodiments.

(Unbiased Sample Amplification)

The present invention can use next generation sequencing techniques to prepare a sample for quantitative analysis of a repertoire of a variable region of a T cell receptor (TCR) or a B cell receptor (BCR). Such sequencing techniques can obtain a million or more reads from a sample at a reasonable cost. Even a genotype that exists at a low frequency of $\frac{1}{1000000}$ or less can be detected by using these techniques in a specific and unbiased manner. An unbiased amplification method for amplifying all different types of sequences of a specific portion of a gene or a transcript from a sample derived from a DNA of blood, bone marrow or the like is achieved.

In one aspect, the present invention provides a method of preparing a sample for quantitative analysis of a repertoire of a variable region of a T cell receptor (TCR) or B cell receptor (BCR) by genetic sequence analysis using a database, the method comprising the steps of: (1) synthesizing a complementary DNA by using an RNA sample derived from a target cell as a template; (2) synthesizing a double stranded complementary DNA by using the complementary DNA as a template; (3) synthesizing an adaptor-added double stranded complementary DNA by adding a common adaptor primer sequence to the double stranded complementary DNA; (4) performing a first PCR amplification reaction by using the adaptor-added double stranded complementary DNA, a common adaptor primer consisting of the common adaptor primer sequence, and a first TCR or BCR C region specific primer, wherein the first TCR or BCR C region specific primer is designed to comprise a sequence that is sufficiently specific to a C region of interest of the TCR or BCR and not homologous with other genetic sequences, and comprise a mismatching base between subtypes downstream when amplified; (5) performing a second PCR amplification reaction by using a PCR amplicon of (4), the common adaptor primer, and a second TCR or BCR C region specific primer, wherein the second TCR or BCR C region specific primer is designed to have a sequence that is a complete match with the TCR or BCR C region in a sequence downstream the sequence of the first TCR or BCR C region specific primer, but comprise a sequence that is not homologous with other genetic sequences, and comprise a mismatching base between subtypes downstream when amplified; and (6) performing a third PCR amplification reaction by using a PCR amplicon of (5), an added common adaptor primer in which a nucleic acid sequence of the common adaptor primer comprises a first additional adaptor nucleic acid sequence, and an adaptor-added third TCR or BCR C region specific primer in which a second additional adaptor nucleic acid sequence and a molecule identification (MID Tag) sequence are added to a third TCR or BCR C region specific sequence; wherein the third TCR or BCR C region specific primer is designed to have a sequence that is a complete match with the TCR or BCR C region in a sequence downstream to the sequence of the second TCR or BCR C region specific primer, but comprise a sequence that is not homologous with other genetic sequences, and comprise a mismatching base between subtypes downstream when amplified, the first additional adaptor nucleic acid sequence is a sequence suitable for binding to a DNA capturing bead and for an emPCR reaction, the second additional adaptor nucleic acid sequence is a sequence suitable for an emPCR reaction, and the molecule identification (MID Tag) sequence is a sequence for imparting uniqueness such that an amplicon can be identified.

Conventional methods could not achieve unbiasedness in the truest sense. However, the present invention can achieve unbiased amplification and perform accurate analysis. In regards to unbiasedness, SMART PCR or the like is used in some cases. However, this method cannot achieve precise unbiasedness. The reason therefor is the following. SMART PCR is a method utilizing terminal transferase activity of a reverse transcriptase derived from Moloney Murine Leukemia Virus (MMLV). That is, when a reverse transcriptase reaches the 5' terminal of an mRNA that is a template in a complementary strand DNA synthesis reaction, a secondary reaction that mainly adds a C base to the 3' terminal of the newly synthesized complementary DNA is utilized. A primer (TS oligo) having a base sequence (GGG) complementary to the added base (CCC) at the 3' terminal is used to change a template upon a reverse transcription reaction, resulting in synthesis of a double strand. Thus, the method is known to have a disadvantage wherein addition reactions of TS oligo continuously occur to form a TS oligo concatemer (Villanyi Z, Mai, A, Szabad J. Repeated template switching: Obstacles in cDNA libraries and ways to avoid them. The open genomics journal, 2012, 5, 1-6). Further, the method is known to have a disadvantage wherein progression of polymerase is inhibited by TS oligo in a gene with a sequence that is identical or similar to the 3' side sequence of the TS oligo, resulting in producing a bias (Tang D T, Plessy C, Salimullah M, Suzuki A M, Calligaris R, Gustincich S, Carninci P. Suppression of artifacts and barcode bias in high-throughput transcriptome analyses utilizing template switching. Nucleic Acids Res. 2013 Feb. 1; 41(3): e44). In fact, it is reported that the correlation is low between a standard reverse transcription reaction or an in vitro transcription and SMART PCR using microarray analysis (Puskas L G, Zvara A, Hackler L Jr, Van Hummelen P.RNA amplification results in reproducible microarray data with slight ratio bias. Biotechniques. 2002 June; 32(6): 1330-4, 1336, 1338, 1340). Further, it is reported in repeated tests of each detection method that SMART PCR exhibits lower reproducibility than the other two methods (Puskas L G, et al., Biotechniques. 2002 June; 32(6): 1330-4, 1336, 1338, 1340).

In one embodiment where quantitative analysis is performed on a repertoire of a variable region of a BCR, the C region specific primer comprises a sequence that is a complete match with an isotype C region of interest selected from the group consisting of IgM, IgA, IgG, IgE and IgD and has a sequence that is not homologous with other C regions. Preferably, the C region specific primer is a sequence that is a complete match with one of the subtypes IgG1, IgG2, IgG3 and IgG4 or one of IgA1 and IgA2 for IgA or IgG. In another embodiment where quantitative analysis is performed on a repertoire of a variable region of a TCR, the C region specific primer is a sequence that is a complete match with a C region of a chain of interest selected from the group consisting of α chain, β chain, γ chain and δ chain and is not homologous with other C regions.

In another embodiment, it is preferable that a portion of a sequence that is a complete match with all C region allelic sequences of the same isotype in the database is selected for the C region specific primer. Such election of a complete match enables highly precise analysis.

In a preferred embodiment, the common adaptor primer is designed such that the primer is unlikely to have homodimer and intramolecular hairpin structures and can stably form a double strand, and designed not to be highly homologous with all TCR genetic sequences in the database and to have the same level of Tm as the C region specific primer. Examples of such a common adaptor primer sequence include TAATACGACTCCGAATTCCC (SEQ ID NO: 2), GGGAATTCGG (P10EA; SEQ ID NO: 3) and the like.

In a preferred embodiment, the common adaptor primer designed not to have homodimer and intramolecular hairpin structures and to have homology with other genes comprising a BCR or TCR is selected. Examples of such a common adaptor primer sequence include P20EA, P10EA and the like.

In a specific embodiment, the common adaptor primer is P20EA and/or P10EA, and the sequence thereof is TAATACGACTCCGAATTCCC (P20EA; SEQ ID NO: 2), GGGAATTCGG (P10EA; SEQ ID NO: 3).

In a preferred embodiment, the first, second and third TCR or BCR C region specific primers are each independently a primer for BCR repertoire analysis, the primer being selected to be a sequence that is a complete match with each isotype C region of IgM, IgG, IgA, IgD or IgE, and a complete match with subtypes for IgG and IgA, and not homologous with other sequences comprised in the database, and comprise a mismatching base between subtypes downstream of the primer, and wherein the common adaptor primer sequence is designed such that the sequence has a base length suitable for amplification, is unlikely to have homodimer and intramolecular hairpin structures, and is able to stably form a double strand, and designed not to be homologous with genetic sequences other than a target sequence in the database (or not homologous with other genes comprising a BCR or TCR other than a target sequence) and designed to have the same level of Tm as the C region specific primer. Examples of such a sequence include, are not limited to, P20EA (TAATACGACTCCGAATTCCC (SEQ ID NO: 2)) and P10EA (GGGAATTCGG (SEQ ID NO: 3)).

In a preferred embodiment, the first, second and third TCR C region specific primers are each independently a primer for TCR or BCR repertoire analysis, each primer being selected to be a sequence that is a complete match with 1 type of α chain (TRAC), 2 types of β chains (TRBC01 and TRBCO2), 2 types of γ chains (TRGC1 and TRGC2), and one type of δ chain (TRDC1) and is not homologous with other sequences comprised in the database, and to comprise a mismatching base between subtypes downstream of the primer, wherein the common adaptor primer sequence is designed such that the sequence has a base length suitable for amplification, is unlikely to have homodimer and intramolecular hairpin structures, and is able to stably form a double strand, and designed not to be highly homologous with all TCR genetic sequences in the database and to have the same level of Tm as the C region specific primer. Examples of such a sequence include, but are not limited to, P20EA (TAATACGACTCCGAATTCCC (SEQ ID NO: 2)), P10EA (GGGAATTCGG (SEQ ID NO: 3)).

In a preferred embodiment, the third TCR or BCR C region specific primer is set in a region that is up to about 150 bases from the 5' terminal side of a C region, and the first TCR or BCR C region specific primer and the second TCR or BCR C region specific primer are set between the 5' terminal side of a C region to about 300 bases.

In a preferred embodiment, the first, second and third TCR or BCR C region specific primers are each independently for BCR quantitative analysis, wherein separate specific primers are set to 5 types of isotype sequences, and the primers are designed to completely match a target sequence and ensure a mismatch of 5 bases or more for other isotypes and are designed to be a complete match with all subtypes such that one type of primer is compatible with each similar IgG subtype (IgG1, IgG2, IgG3 and IgG4) or IgA subtype (IgA1 and IgA2). Examples of such a sequence include the following that are used in the Examples, but are not limited to: CM1 (SEQ ID NO: 5), CA1 (SEQ ID NO: 8), CG1 (SEQ ID NO: 11), CD1 (SEQ ID NO: 14), CE1 (SEQ ID NO: 17), CM2 (SEQ ID NO: 6), CA2 (SEQ ID NO: 9), CG2 (SEQ ID NO: 12), CD2 (SEQ ID NO: 15), CE2 (SEQ ID NO: 18), CM3-GS (SEQ ID NO: 7), CA3-GS (SEQ ID NO: 10), CG3-GS (SEQ ID NO: 13), CD3-GS (SEQ ID NO: 16) and CE3-GS (SEQ ID NO: 19).

In a preferred embodiment, parameters in primer design are set to: a base sequence length of 18-22 bases; a melting temperature of 54-66° C.; and % GC (% guanine·cytosine content) of 40-65%. Preferably, in addition to such parameters, parameters are set to: a base sequence length of 18-22 bases; a melting temperature of 54-66° C.; and % GC (% guanine·cytosine content) of 40-65%; a self-annealing score of 26; a self-end annealing score of 10; and a secondary structure score of 28 (for a Roche sequencer used in the Examples). Although these preferred values of base sequence length and the like may vary depending on the sequencer model, those skilled in the art can appropriately set parameters in accordance with the sequencer model.

In a preferred embodiment, conditions for a method of determining sequences of the first, second and third TCR or BCR C region specific primers include the following: 1. a plurality of subtype sequences and/or allelic sequences are uploaded into a base sequence analysis software and aligned; 2. a primer designing software is used to search for a plurality of primers satisfying a parametric condition in a C region; 3. a primer in a region without a mismatching base in the aligned sequences in 1 is selected; and 4. the presence of a plurality of mismatching sequences for each subtype and/or allele downstream of the primer determined in 3 is confirmed, and if there is no such sequence, a primer is searched further upstream, which is optionally further repeated.

In a preferred embodiment, the first TCR or BCR C region specific primer is set in a position at bases 41-300 with a first base of a first codon of a C region sequence produced by splicing as a baseline, the second TCR or BCR C region specific primer is set in a position at bases 21-300 with said first base as the baseline, and the third TCR or BCR C region specific primer is set in a position within 150 bases or less with said first base as the baseline, and the positions comprise a mismatching site in a subtype and/or allele.

In a preferred embodiment, the first TCR or BCR C region specific primer can have, but is not limited to, the following structure: CM1 (SEQ ID NO: 5), CA1 (SEQ ID NO: 8), CG1 (SEQ ID NO: 11), CD1 (SEQ ID NO: 14), CE1 (SEQ ID NO: 17), CA1 (SEQ ID NO: 35), CB1 (SEQ ID NO: 37) or the like.

In a preferred embodiment, the second TCR or BCR C region specific primer can have, but is not limited to, the following structure: CM2 (SEQ ID NO: 6), CA2 (SEQ ID NO: 9), CG2 (SEQ ID NO: 12), CD2 (SEQ ID NO: 15), CE2 (SEQ ID NO: 18), CA2 (SEQ ID NO: 35), and CB2 (SEQ ID NO: 37) or the like.

In a preferred embodiment, the third TCR or BCR C region specific primer can have, but is not limited to, the following structure: CM3-GS (SEQ ID NO: 7), CA3-GS (SEQ ID NO: 10), CG3-GS (SEQ ID NO: 13), CD3-GS (SEQ ID NO: 16) CE3-GS (SEQ ID NO: 19) or the like.

In a preferred embodiment, each of the TCR or BCR C region specific primers is provided in a set compatible with all TCR or BCR subclasses. The specific sequence thereof includes the following: CM1 (SEQ ID NO: 5), CA1 (SEQ ID NO: 8), CG1 (SEQ ID NO: 11), CD1 (SEQ ID NO: 14), CE1 (SEQ ID NO: 17), CM2 (SEQ ID NO: 6), CA2 (SEQ ID NO: 9), CG2 (SEQ ID NO: 12), CD2 (SEQ ID NO: 15), CE2 (SEQ ID NO: 18), CM3-GS (SEQ ID NO: 7), CA3-GS (SEQ ID NO: 10), CG3-GS (SEQ ID NO: 13), CD3-GS (SEQ ID NO: 16), CE3-GS (SEQ ID NO: 19), CA1 (SEQ ID NO: 35), CB1 (SEQ ID NO: 37), CA2 (SEQ ID NO: 35), CB2 (SEQ ID NO: 37) and the like.

(Large-Scale Analysis)

In another aspect, the present invention provides a method of performing gene analysis using a sample manufactured by the method of the present invention.

Gene analysis can be performed by using any analysis technology. For example, it is possible to use a technology of assigning V, D, J, and C sequences of each read sequence by using V, D, J, and C sequences obtained from a known IMGT (the international ImMnunoGeneTics information system, http colon//www dot imgt dot org) database as a reference sequence and utilizing HighV-Quest of the IMGT or a novel software (Repertoire Genesis) developed by the Applicant, which was filed concurrently and described herein as a preferred example of an analysis system.

In a preferred embodiment, the gene analysis is the quantitative analysis of a repertoire of a variable region of a T cell receptor (TCR) or a B cell receptor (BCR).

Different sequences can be distinguished by sequencing individual amplification molecules. Thus, sequencing has sensitivity to detect a quantitative change in clone proliferation. In summary, one provided embodiment of the present invention provides a method of determining a profile of a recombinant DNA sequence in a T cell and/or B cell. The present method may comprise the steps of: isolating a sample from a subject; performing one or more rounds of nucleic acid amplification and spatially isolation of individual nucleic acids; and sequencing the nucleic acids.

One aspect provides a method of determining a correlation of one or more repertoires in a subject or an individual. Another aspect provides a method of developing an algorithm capable of predicting a correlation of one or more repertoires in any sample derived from a subject having a disease. Another aspect provides a method of using an algorithm capable of predicting a correlation of one or more repertoires in any sample derived from a subject to find a correlation of one repertoire of an individual or correlation of a plurality of repertoires. Another aspect provides a method of creating an algorithm that calculates a disease activity score. Another aspect provides a method of monitoring a condition of a disease of an individual.

(Analysis System)

The present invention provides bioinformatics for performing quantitative analysis of a repertoire of a variable region of a T cell receptor (TCR) or a B cell receptor (BCR) by using a next generation sequencing technique.

In one aspect, the present invention is a method of analyzing a TCR or BCR repertoire, comprising the following steps: (1) providing a reference database for each gene region comprising at least one of a V region, a D region, a J region and optionally a C region; (2) providing an input sequence set which is optionally trimmed and optionally extracted to have a suitable length; (3) searching for homology of the input sequence set with the reference database for the each gene region and recording an alignment with an approximate reference allele and/or a sequence of the reference allele; (4) assigning the V region and the J region for the input sequence set and extracting a nucleic acid sequence of the D region based on a result of assigning (preferably, assigning the V region and the J region for the input sequence set and extracting a CDR3 sequence, with the front of CDR3 on a reference V region and end of CDR3 on reference J as guides); (5) translating the nucleic acid sequence of the D region into an amino acid sequence and classifying the D region by utilizing the amino acid sequence (preferably translating the nucleic acid sequence of the CDR3 into an amino acid sequence and classifying the D region by utilizing the amino acid sequence); and (6) calculating a frequency of appearance for each of the V region, the D region, and the J region and optionally the C region or a frequency of appearance of a combination thereof based on the classifying in (5) to derive the TCR or BCR repertoire.

Figure 43:
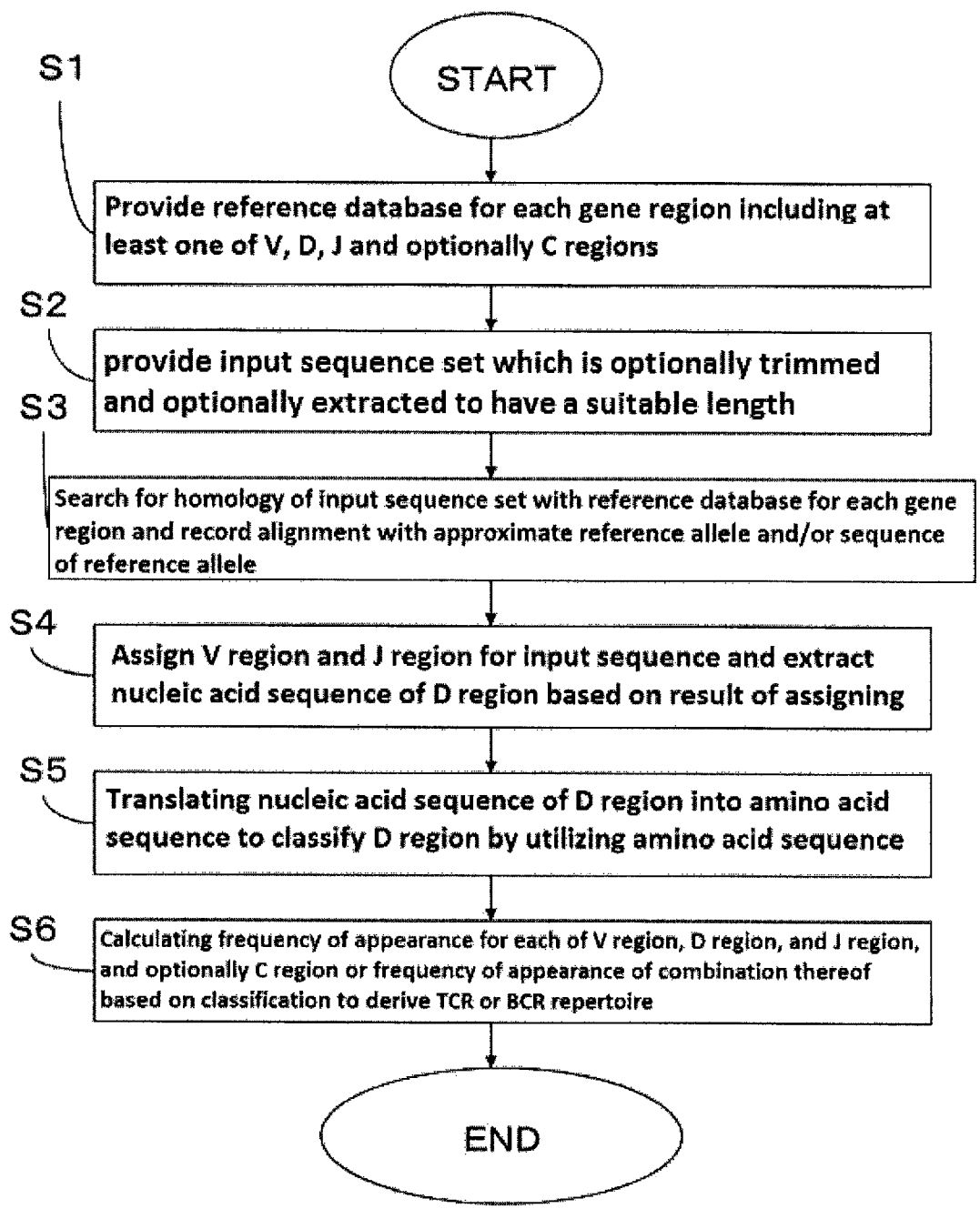
FIG. 43 shows a flow chart for the processing of the present invention.

Each step of the present invention is explained with specific operation of each system or apparatus while referring to the flow chart in FIG. 43.

FIG. 43 is a flow chart showing a processing flow demonstrating a method of analyzing a TCR or BCR repertoire in the gene analysis system of the present invention. Further, each of the symbols S1-S6 in the Figure corresponds to each of steps (1)-(6) in the following explanation.

In the method of the present invention, (1) providing a reference database for each gene region comprising at least one of a V region, a D region, a J region and optionally a C region can be accomplished, for example for the V region, by appropriately selecting and providing a database comprising and providing information on the V region.

In the method of the present invention, (2) providing an input sequence set which is optionally trimmed and optionally extracted to have a suitable length is accomplished by optional trimming with a function of an appropriate software or the like and optionally providing an extracted input sequence set after appropriately selecting a length. An input sequence may be, for example, a set of amplicons amplified by a known method or a set of amplicons amplified by PCR with an unbiased method as described in the application submitted concurrently with the present application.

In the method of the present invention, (3) searching for homology of the input sequence set with the reference database for the each gene region and recording an alignment with an approximate reference allele and/or a sequence of the reference allele is performed by appropriately using a software for performing homology search, for each gene range (for example, the V region and the like), performing homology search with a reference database on the input sequence set, and recording alignment with an approximate reference allele and/or a sequence of the reference allele obtained as a result. In FIGS. 29 and 30, the box of "BLAST" or "BLAST analysis", the IMGT database therebelow, and the vertical double line connecting the two correspond thereto.

In the method of the present invention, (4) assigning the V region and the J region for the input sequence set and extracting a nucleic acid sequence of the D region based on a result of assigning can be accomplished by determining a V region and/or J region based on known information from a sequence alignment. Such extraction can be accomplished by assigning the V region and the J region for the input sequence set and extracting a CDR3 sequence, with the front of CDR3 on a reference V region and end of CDR3 on reference J as guides. In FIGS. 29 and 30, defining both ends of a region as in the horizontal arrow under Dno, with the horizontal arrow under V and the horizontal arrow under J as guides, corresponds to extraction of a CDR3 sequence.

In the method of the present invention, (5) translating the nucleic acid sequence of the D region into an amino acid sequence and classifying the D region by utilizing the amino acid sequence can be accomplished by translating into an amino acid using a known method in the art and picking out a sequence corresponding to the D region by homology search or the like on the amino acid sequence. Preferably, the nucleic acid sequence of the CDR3 can be translated into an amino acid sequence and the D region is classified by utilizing the amino acid sequence.

In the method of the present invention, (6) calculating a frequency of appearance for each of the V region, the D region, and the J region and optionally the C region or a frequency of appearance of a combination thereof based on the classifying in (5) to derive the TCR or BCR repertoire can be accomplished by calculating a frequency of appearance of the V region, D region, J region and/or the C region calculated in the above-described step, for example, by organizing the frequencies into a list. A TCR or BCR repertoire can be derived thereby.

Figure 42:
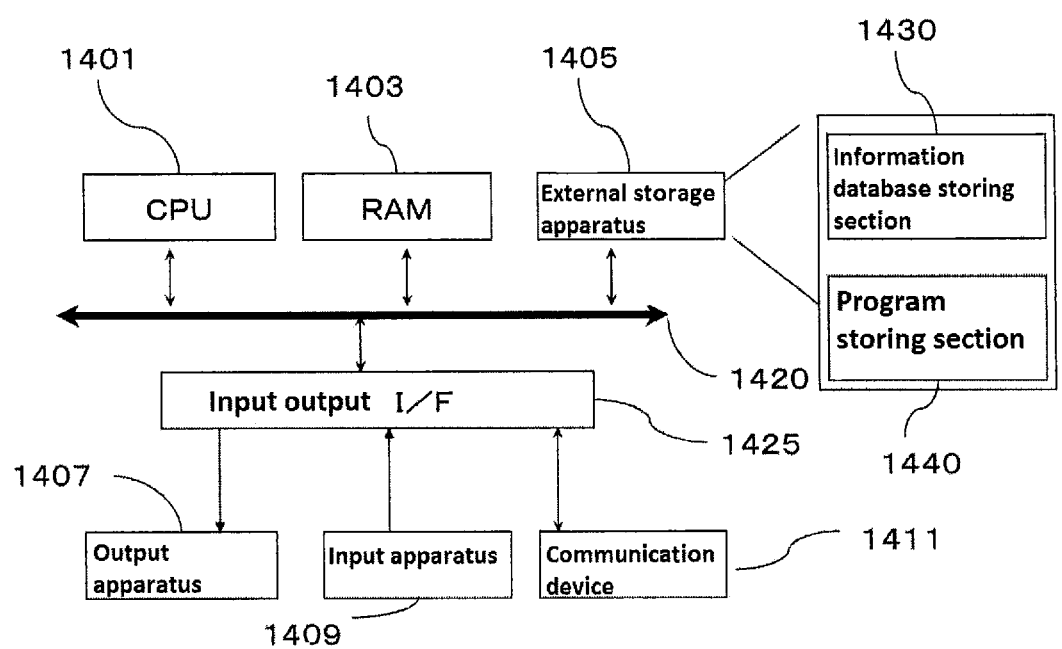
FIG. 42 shows a block diagram of the system of the present invention.

The following steps are further explained while referring to FIG. 42.

In S1 (step (1)), a reference database is provided. This may be stored in an external storage apparatus 1405, but can generally be obtained as a publically disclosed database through a communication device 1411. Alternatively, an input apparatus 1409 may be used to input and optionally record a database in a RAM 1403 or the external storage apparatus 1405. In this regard, a database comprising a region of interest such as a V region is provided.

In S2 (step (2)), an input sequence set is provided. For example, a set of sequence information obtained from a set of amplicons amplified in a PCR amplification reaction is inputted by using the input apparatus 1409 or through the communication device 1411. In this regard, an apparatus that receives an amplicon of a PCR amplification reaction and performs genetic sequence analysis thereon may be connected. Such a connection is made through a system bus 1420 or through the communication device 1411. Trimming and/or extraction of a suitable length can be optionally performed at this stage. Such processing is performed with a CPU 1401. A program for trimming and/or extraction may be provided via each of the external storage apparatus, communication device, or input apparatus.

In S3 (step (3)), alignment is performed. At this stage, homology search is performed on the input sequence set with the reference database for each of the gene regions. For the homology search, the reference database obtained via the communication device 1411 or the like is processed with a homology search program. The CPU 1401 performs the processing. Further, results obtained as a result thereof are analyzed for alignment with an approximate reference allele and/or a sequence the reference allele. This is also processed by the CPU 1401. A program for the execution thereof may be provided via each of the external storage apparatus, communication device, or input apparatus.

In S4 (step (4)), nucleic acid sequence information on D is detected. This is also processed by the CPU 1401. A program for the execution thereof may be provided via each of the external storage apparatus, communication device, or input apparatus. This step assigns a V region and a J region for the input sequence set. Assignment is also processed by the CPU 1401. Further, the CPU 1401 also extracts a nucleic acid sequence of the D region based on a result of assigning. A program for the assigning and extracting process may also be provided via each of the external storage apparatus, communication device, or input apparatus. Preferably, this step can be accomplished by determining a V region and/or J region based on known information from sequence alignment. Results can be stored in the RAM 1403 or external storage apparatus 1405. Preferably, such extraction can be accomplished by assigning the V region and the J region for the input sequence set and extracting a CDR3 sequence, with the front of CDR3 on a reference V region and end of CDR3 on reference J as guides. Such processing can also be performed by the CPU 1401. A program therefor may also be provided via each of the external storage apparatus, communication device, or input apparatus.

In S5 (step (5)), a D region is classified. A nucleic acid sequence of the D region is translated into an amino acid sequence and the D region is classified by utilizing the amino acid sequence. This is also processed by the CPU 1401. A program for this processing may also be provided via each of the external storage apparatus, communication device, or input apparatus. A sequence corresponding to the D region may be picked up by homology search or the like on the obtained amino acid sequence. This is also processed by the CPU 1401. A program for this processing may also be provided via each of the external storage apparatus, communication device, or input apparatus. Preferably, a nucleic acid sequence of the CDR3 can be translated into an amino acid sequence to classify the D region by utilizing the amino acid sequence. This is also processed by the CPU 1401. A program for this processing may also be provided via each of the external storage apparatus, communication device, or input apparatus.

In S6 (step (6)), a frequency of appearance for each of the V region, the D region, and the J region and optionally the C region or a frequency of appearance of a combination thereof is calculated based on the above-described classifying to derive a TCR or BCR repertoire. The calculating and deriving are also processed by the CPU 1401. A program for this processing may also be provided via each of the external storage apparatus, communication device, or input apparatus.

In one preferred embodiment, the gene region used in the present invention comprises all of the V region, the D region, the J region and optionally the C region.

In one embodiment, the reference database is a database with a unique ID assigned to each sequence. A sequence of a gene can be analyzed based on a simple indicator, i.e., ID, by uniquely assigning an ID.

In one embodiment, the input sequence set is an unbiased sequence set. An unbiased sequence set can be implemented by PCR amplification with an unbiased method as described herein. When precision is not required for an unbiased method, "pseudo-unbiased method" with a relatively low quality such as the Smart method may be used. Thus, "unbiased" as used herein refers to unbiasedness with precision as accomplished by the method of the present invention. When such a level is not attained, a method is referred to as a "pseudo-unbiased method". When an unbiased method as described herein is to be particularly distinguished, the term "precisely unbiased" may be used. However, it is understood that even without a specific description of "precisely", unbiasedness herein is at a level accomplished by using the method as described herein.

In another embodiment, the sequence set is trimmed. An unnecessary or unsuitable nucleic acid sequence can be removed by trimming, such that efficiently of analysis can be enhanced.

In a preferred embodiment, trimming is accomplished by the steps of: deleting low quality regions from both ends of a read; deleting a region matching 10 bp or more with an adaptor sequence from the both ends of the read; and using the read as a high quality read in analysis when a remaining length is 200 bp or more (TCR) or 300 bp or more (BCR). Preferably, the low quality refers to a 7 bp moving average of QV value less than 30.

In a preferred embodiment, the approximate sequence is the closest sequence. In a specific embodiment, the approximate sequence is determined by a ranking of 1. number of matching bases, 2. kernel length, 3. score, and 4. alignment length.

In another embodiment, the homology search is conducted under a condition tolerating random mutations to be scattered throughout. Such a condition is often expressed by the following condition for BLAST/FASTA optimal parameters: tolerates a maximum mismatch of 33% across the full length of an alignment; and tolerates a maximum nonconsecutive mismatch of 60% for any 30 bp therein. In one embodiment, the homology search comprises at least one condition from (1) shortening of a window size, (2) reduction in a mismatch penalty, (3) reduction in a gap penalty, and (4) a top priority ranking of an indicator is a number of matching bases, compared to a default condition.

In another embodiment, the homology search is carried out under the following conditions in BLAST or FASTA:

V mismatch penalty=−1, shortest alignment length=30, and shortest kernel length=15;

D word length=7 (for BLAST) or K-tup=3 (for FASTA), mismatch penalty=−1, gap penalty=0, shortest alignment length=11, and shortest kernel length=8;

J mismatch penalty=−1, shortest hit length=18, and shortest kernel length=10; and C shortest hit length=30 and shortest kernel length=15.

This condition can also be used, for example, as long as it is a situation where a shorter (about 200 bp) sequence is used to classify only part of a region (situation that does not fall under the "preferred example"). In addition, this condition can also be used in a situation where an Illumina sequencer is used. In this case, possibility of using bwa or bowtie for homology search is considered.

In a specific embodiment, the D region is classified by a frequency of appearance of the amino acid sequence.

In a further embodiment, a combination of a result of search for homology with the nucleic acid sequence of CDR3 and a result of amino acid sequence translation is used as a classification result when there is a reference database for the D region in the step (5).

In another embodiment, only the frequency of appearance of the amino acid sequence is used for classification when there is no reference database for the D region in the step (5).

In a specific embodiment, the frequency of appearance is counted in a unit of a gene name and/or a unit of an allele.

In another embodiment, the step (4) comprises the step of assigning the V region and the J region for the input sequence set and extracting a CDR3 sequence, with the front of CDR3 on a reference V region and end of CDR3 on reference J as guides.

In a further embodiment, the step (5) comprises translating the nucleic acid sequence of the CDR3 into an amino acid sequence and classifying a D region by using the amino acid sequence.

In one aspect, the present invention provides a system for analyzing a TCR or BCR repertoire, wherein the system comprises: (1) means for providing a reference database for each gene region comprising at least one of a V region, a D region, a J region and optionally a C region; (2) means for providing an input sequence set which is optionally trimmed and optionally extracted to have a suitable length; (3) means for searching for homology of the input sequence set with the reference database for the each gene region and recording an alignment with an approximate reference allele and/or a sequence of the reference allele; (4) means for assigning the V region and the J region for the input sequence set and extracting a nucleic acid sequence of the D region based on a result of assigning; (5) means for translating the nucleic acid sequence of the D region into an amino acid sequence and classifying the D region by utilizing the amino acid sequence; and (6) means for calculating a frequency of appearance for each of the V region, the D region, and the J region and optionally the C region or a frequency of appearance of a combination thereof based on the classifying in (5) to derive the TCR or BCR repertoire.

In another aspect, the present invention provides a computer program for having a computer execute processing of a method of analyzing a TCR or BCR repertoire, the method comprising the following steps: (1) providing a reference database for each gene region comprising at least one of a V region, a D region, a J region and optionally a C region; (2) providing an input sequence set which is optionally trimmed and optionally extracted to have a suitable length; (3) searching for homology of the input sequence set with the reference database for the each gene region and recording an alignment with an approximate reference allele and/or a sequence of the reference allele; (4) assigning the V region and the J region for the input sequence set and extracting a nucleic acid sequence of the D region based on a result of assigning; (5) translating the nucleic acid sequence of the D region into an amino acid sequence and classifying the D region by utilizing the amino acid sequence; and (6) calculating a frequency of appearance for each of the V region, the D region, and the J region and optionally the C region or a frequency of appearance of a combination thereof based on the classifying in (5) to derive the TCR or BCR repertoire.

In still another aspect, the present invention provides a recording medium for storing a computer program for having a computer execute processing of a method of analyzing a TCR or BCR repertoire, the method comprising the following steps: (1) providing a reference database for each gene region comprising at least one of a V region, a D region, a J region and optionally a C region; (2) providing an input sequence set which is optionally trimmed and optionally extracted to have a suitable length; (3) searching for homology of the input sequence set with the reference database for the each gene region and recording an alignment with an approximate reference allele and/or a sequence of the reference allele; (4) assigning the V region and the J region for the input sequence set and extracting a nucleic acid sequence of the D region based on a result of assigning; (5) translating the nucleic acid sequence of the D region into an amino acid sequence and classifying the D region by utilizing the amino acid sequence; and (6) calculating a frequency of appearance for each of the V region, the D region, and the J region and optionally the C region or a frequency of appearance of a combination thereof based on the classifying in (5) to derive the TCR or BCR repertoire.

(System Configuration)

The configuration of a system 1 of the present invention is explained while referring to the functional block diagram in FIG. 42. The Figure shows a case that is materialized with a single system.

The gene analysis system 1 of the present invention is configured by connecting a RAM 1403, external storage apparatus 1405 such as ROM, HDD, magnetic disk, or flash memory such as USB memory and an input output interface (I/F) 1425 via a system bus 1420 to the CPU 1401 installed in a computer system. An input apparatus 1409 such as a keyboard or a mouse, an output apparatus 1407 such as a display, and a communication device 1411 such as a modem are each connected to the input output I/F 1425. The external storage apparatus 1405 comprises an information database storing section 1430 and a program storing section 1440, which are both constant storage regions reserved in the external storage apparatus 1405.

Such a hardware configuration is designed to achieve a function of the present invention in cooperation with an OS (operating system) by the CPU 1401 calling out, deploying, and executing a software program installed on the storage apparatus 1405 on the RAM 1403 from having various instructions (commands) being input via the input apparatus 1409 or from receiving a command via the communication I/F, communication device 1411 or the like.

A reference database, input sequence set, created classification data, data of a TCR or BCR repertoire or the like, or information obtained via the communication device 1411 or the like is constantly written and updated into the database storage section 1430. Information on each sequence in each input sequence set and information such as information ID of each gene in a reference database are managed with each master table to allow information from a sample that is subjected to accumulation to be managed by IDs defined in each master table.

As input sequence set entry information, a sample provider ID, sample information, result of nucleic acid analysis, known individual/physiological information and result of TCR or BCR repertoire analysis are associated with an ID and stored in the database storage section 1430. In this regard, the result of TCR or BCR repertoire analysis is information obtained via the processing of the nucleic acid analysis result by the processing of the present invention.

Further, a computer program stored in the program storing section 1440 configures a computer as a system for implementing the above-described processing system, e.g., a system for implementing processing such as trimming, extraction, alignment, assignment, classification, or translation. Each of the features is an independent computer program, module or routine thereof or the like, which is executed by the above-described CPU 1401 to configure a computer as each system or apparatus. Hereinafter, each system is constructed by cooperation of each function in each system.

(Repertoire Analysis System/Analysis Method)

In one aspect, the present invention provides a method of quantitatively analyzing a repertoire of a variable region of a T cell receptor (TCR) or a B cell receptor (BCR) of a subject by using a database. The method comprises: (1) providing a nucleic acid sample comprising a nucleic acid sequence of the T cell receptor (TCR) or the B cell receptor (BCR) which is amplified from the subject in an unbiased manner; (2) determining the nucleic acid sequence comprised in the nucleic acid sample; and (3) calculating a frequency of appearance of each gene or a combination thereof based on the determined nucleic acid sequence to derive a TCR or BCR repertoire of the subject. This method and methods comprising one or more additional features explained herein are called "repertoire analysis method of the present invention" herein. In addition, a system materializing the repertoire analysis method of the present invention is referred to as the "repertoire analysis system of the present invention".

The (1) providing a nucleic acid sample comprising a nucleic acid sequence of the T cell receptor (TCR) or the B cell receptor (BCR) which is amplified from the subject in an unbiased manner in the method of the present invention may provide any sample as long as the sample is suitable for determining a nucleic acid sequence. As such a technology, it is possible to use the above-described preferred amplification methods of the present invention as well as Reverse transcriptase-PCR, real-time PCR, digital PCR, emulsion PCR, amplified fragment length polymorphism (AFLP) PCR, allele specific PCR, assembly PCR, asymmetrical PCR, colony PCR, helicase-dependent amplification, hot start PCR, inverse PCR, in situ PCR, nested PCR, Touchdown PCR, loop-mediated isothermal PCR (LAMP), Nucleic acid sequence based amplification (NASBA), Ligase Chain Reaction, Branch DNA Amplification, Rolling Circle Amplification, Circle to circle Amplification, SPIA amplification, Target Amplification by Capture and Ligation (TACL), 5'-Rapid amplification of cDNA end (5'-RACE), 3'-Rapid amplification of cDNA end (3'-RACE), Switching Mechanism at 5'-end of the RNA Transcript (SMART).

The (2) determining the nucleic acid sequence comprised in the nucleic acid sample in the method of the present invention may use any method, as long as a nucleic acid sequence can be determined. Generally, a large quantity of sequencing is required. Thus, it is preferable to use an automated large-scale sequencing method. Examples of such a sequencing method include sequencing using a Roche 454 sequencer (GS FLX+, GS Junior), sequencing using the technology of an Ion Torrent sequencer (Ion PGM™ Sequencer), and sequencing using the technology of Illumina (GenomeAnalyzer IIx, Hiseq, Miseq). Other sequencing methods include Heliscope™ Sequencer, Helicos True Single Molecule Sequencing (tSMA) (Harris. T. D. et. al Science 2008, 320-160-109), SoliD™ Sequencing (Life Technologies, Inc.), Single Molecule Real Time (SMRT™) PacBio system (Pacific Biosciences, CA), Nanopore Sequencing (Oxford Nanopore Technologies, UK), LaserGen™ (LaserGen, Inc. CA) (reference: Litosh V A et al., Nucleic Acids Res. 2011 March; 39(6): e39), Lightspeed Genomics™ (Lightspeed Genomics, CA), GnuBIO (GnuBIO Inc., MA), Polonator sequencing (M. Danaher/Dover, Azco Biotec. Inc., CA), Mebious Biosystem's single molecule sequencing (Mebious Biosystems Limited), Millikan sequencing (Caerus Molecular Diagnostics, Inc), Intelligent Bio-Systems, Inc. (reference: Hutter D, et al Nucleosides Nucleotides Nucleic Acid 2010; 29(11):879-95), Hybridization-Assisted Nanopore Sequencing (Nabsys Inc., RI), Nanopore sequencing (Noblegen Biosciences, Inc.), Nanopore sequencing (Electronic Biosciences, CA), Thermosequencing (GENIUS™ technology) (Genapsys, Inc., CA), CAERUS MOLECULAR DIAGNOSTICS, INC, CA, Individual Molecule Placement Rapid Nanotransfer (IMPRNT) (Halcyon Molecular, Inc), Monochromatic aberration-corrected dual-beam low energy electron microscopy (Electron Optica, Inc., CA), ZS Genesis DNA Sequencing (ZS Genetyics, Inc) and the like. A Roche 454 sequencer creates a single stranded DNA bound to two types of adaptors which specifically bind to the 3' terminal and the 5' terminal. The single stranded DNA is bound to a bead via an adaptor and wrapped in a water-in-oil emulsion to form a microreactor having a bead and a DNA fragment. A gene of interest is then amplified by emulsion PCR in the water-in-oil emulsion. The bead is applied to a picotiter plate and sequenced. ATP is generated by sulfrylase, with pyrophosphoric acid generated when dNTP is taken up into a DNA by DNA polymerase as a substrate (Pyrosequencing). With the ATP and Luciferin as the substrate, luciferase emits fluorescence, which is detected with a CCD camera to determine a base sequence. For the technology of Ion Torrent, emulsion PCR is performed by the same method as Roche, and then a bead is transferred to a microchip, where a sequencing reaction is performed. For detection, the hydrogen ion concentration released when a DNA is extended by polymerase is detected on a semiconductor chip and converted to a base sequence. The sequencing of Illumia is a method of sequencing while amplifying and synthesizing a DNA of interest on a flow cell by the technology of bridge PCR and sequencing-by-synthesis. Bridge PCR creates a single stranded DNA, to which different adaptor sequences are added to both ends. An adaptor sequence is immobilized on the 5' terminal side in advance on a flow cell, where it is immobilized on to the flow cell by an extension reaction. Similarly, an adaptor is immobilized on the 3' terminal side at an adjacent position and binds to the 3' terminal of a synthesized DNA to synthesize a double stranded DNA while forming a so-called bridge. Bridge binding→extension→denaturation are then repeated such that numerous single stranded DNA fragments are locally amplified to form an accumulated cluster. With such a single stranded DNA as a template, sequencing is performed. For sequencing-by-synthesis, after a sequencing primer is added, a single base synthesizing reaction is performed with 3' terminal block fluorescent dNTP using DNA polymerase. A fluorescent substance bound to a base is excited by a laser light, and light emission is recorded as a picture by a fluorescence microscope. The base sequence is then determined by proceeding with a step of removing the fluorescent substance and the block to perform the next extension reaction and detecting fluorescence. Preferably, it is advantageous to sequence a plurality of sequence by a single sequencing. It is also advantageous in that a longer sequence length can be sequenced at once.

For the (3) calculating a frequency of appearance of each gene or a combination thereof based on the determined nucleic acid sequence to derive a TCR or BCR repertoire of the subject in the present invention, any technique can be used as long as a frequency of appearance of genes and a combination thereof can be calculated and a TCR repertoire and/or BCR repertoire can be derived. For example, the analysis tool HighV-Quest provided by the IMGT can be used, in addition to the preferred examples of the aforementioned analysis methods. It is also possible to use other technologies by using a software implemented with an alignment feature or a mapping feature, i.e., AbMapper, ALLPATHS, Arachne, BACCardl, Bfast, BLAT, Bowtie, BWA-MEM, BWA-SW, BWA, CCRa VAT & QuTie, CLC workstation, CNV-seq, Elvira, ERNE-map (rNA), GSMapper, Glimmer, gnumap, Goseq, ICAtools, LOCAS, MapSplice, Maq, MEME, Mosaik, NGSView, Novoalign, OSLay, Partek, Perm, Projector, Qpalma, RazerS, SHARCGS, SHRiMP2, SNP-o-matic, Splicemap, SSAHA2, Stampy, Tablet, TMAP, Tophat, or Velve.

In one embodiment, the nucleic acid sample comprises nucleic acid sequences of a plurality of types of T cell receptors (TCR) or B cell receptors (BCR) and the step (2) for determining a sequence determines the nucleic acid sequence by a single sequencing. The method of the present invention can reduce or eliminate bias that can occur by determining a plurality of types of sequences by a single sequencing. Thus, the present invention is useful especially in accurately detecting a TCR or BCR read that occurs at a low frequency.

In another embodiment, the single sequencing is characterized in that at least one of the sequences used as a primer in amplification from the nucleic acid sample into a sample for sequencing has the same sequence as a nucleic acid sequence encoding a C region or a complementary strand thereof. Any TCR or BCR can be amplified in the same manner to achieve unbiasedness by using a primer having the same sequence as a nucleic acid sequence encoding a C region or a complementary strand thereof.

In another embodiment, the single sequencing is characterized in being performed with a common adaptor primer. In a preferred embodiment, the common adaptor primer is designed such that the primer has a base length suitable for amplification, is unlikely to have homodimer and intramolecular hairpin structures, and is able to stably form a double strand, and designed not to be highly homologous with all TCR genetic sequences in the database and/or to have the same level of melting temperature (Tm) as the C region specific primer. More preferably, the common adaptor primer designed not to have homodimer and intramolecular hairpin structures and to have homology with other genes comprising a BCR or TCR is selected. In a specific embodiment, the common adaptor primer is P20EA (SEQ ID NO: 2) and/or P10EA (SEQ ID NO: 3).

In one embodiment, the unbiased amplification includes being non-V region specific amplification. Bias can be further reduced or eliminated compared to a case of performing unbiased amplification by devising a multiplex or the like using a V specific primer.

In one embodiment, a repertoire targeted by the present invention is the repertoire of a variable region of a BCR, and the nucleic acid sequence is a BCR nucleic acid sequence. BCRs are considered to be prone to having a mutation, especially in a V region. Thus, accurate analysis of a BCR repertoire is difficult with a technology using V region specific amplification.

In one aspect, the present invention provides a method of analyzing a disease, disorder or condition of the subject based on the TCR or BCR repertoire derived based on the repertoire analysis method of the present invention.

In the method of analyzing a disease, disorder or condition of the present invention, the technology of analyzing a disease, disorder or condition of a subject based on a TCR or BCR repertoire derived based on the repertoire analysis method of the present invention starts from linking derived read data consisting of read types, number of reads, read frequency, V region, J region, C region, CDR3 sequence or the like with clinical information such as disease, disorder, or condition to form a database by using a spreadsheet such as EXCEL. First, for a derived individual read sequence: 1. a TCR having a known function such as NKT or MAIT is search; 2. existing public database is searched for collation with a TCR or BCR with a known function such as antigen specificity; 3. the constructed database or an existing public database is searched to associate a common sample origin, property or function with a disease, disorder or condition. Next, for a read sequence in a sample: 1. it is clarified whether a specific read frequency increases (clonality increases); 2. examination is carried out to find out whether a specific V chain or J chain usage frequency increases or decreases depending on the onset of a disease or condition of a disorder; 3. examination is carried out to find out whether the length of a CDR3 sequence in a specific V chain increases or decreases depending on the onset of a disease or condition of a disorder; 4. the composition or sequence of a CDR3 region that changes depending on the onset of a disease or condition of a disorder is examined. 5. a read that appears or disappears depending on the onset of a disease or condition of a disorder is searched; 6. a read that increases or decreases depending on the onset of a disease or condition of a disorder is searched; 7. a read that appears or increase/decrease depending on the onset of a disease or condition of a disorder is searched in another sample and associated with a disease, disorder or condition; 8. a diversity index or similarly index is calculated with a statistical analysis software such as ESTIMATES or R (vegan) by using data such as number of samples, read type, or the number of reads; and 9. a change in the diversity index or similarity index can be associated with the onset of a disease or condition of a disorder.

In one embodiment, the disease, disorder or condition of the subject in the analysis method of the present invention includes, but is not limited to, hematological tumor, colorectal cancer, immune status, rheumatoid arthritis, adult T-cell leukemia, T-cell large granular lymphocyte leukemia, idiopathic thrombocytopenic purpura, and the like.

In another embodiment, the present invention provides a method of treating or preventing the disease, disorder or condition of the subject determined by the method of the present invention, comprising: quantitatively associating the disease, disorder or condition of the subject with the TCR or BCR repertoire; and selecting means for suitable treatment or prevention from the quantitative association.

In one embodiment, diseases, disorders or conditions of a subject targeted in the method of treating or preventing in the present invention include, but are not limited to, hematological tumor, colorectal cancer, immune status, rheumatoid arthritis, adult T-cell leukemia, T-cell large granular lymphocyte leukemia, idiopathic thrombocytopenic purpura, and the like.

In another aspect, the present invention provides a system (analysis system) for quantitatively analyzing a repertoire of a variable region of a T cell receptor (TCR) or a B cell receptor (BCR) of a subject by using a database. The system comprises (1) a kit for providing a nucleic acid sample comprising a nucleic acid sequence of the T cell receptor (TCR) or the B cell receptor (BCR) which is amplified from the subject in an unbiased manner; (2) an apparatus for determining the nucleic acid sequence comprised in the nucleic acid sample; and (3) an apparatus for calculating a frequency of appearance of each gene or a combination thereof based on the determined nucleic acid sequence to derive a TCR or BCR repertoire of the subject. Such a system and systems comprising one or more additional features explained herein are referred to as "repertoire analysis system of the present invention". The repertoire analysis system of the present invention materializes the "repertoire analysis method of the present invention".

In another embodiment, the nucleic acid sample comprises nucleic acid sequences of a plurality of types of T cell receptors (TCR) or B cell receptors (BCR) and the apparatus of (2) is configured to be able to determine the nucleic acid sequences by a single sequencing.

In another embodiment, the single sequencing is characterized in that at least one of the sequences used as a primer in amplification from the nucleic acid sample to a sample for sequencing has the same sequence as a C region. The method of the present invention can reduce or eliminate bias that can occur by determining a plurality of types of sequence by a single sequencing. Thus, the present invention is useful especially in accurately detecting a TCR or BCR read that occurs at a low frequency.

In another embodiment, the single sequencing is characterized in that at least one of the sequences used as a primer in amplification from the nucleic acid sample to a sample for sequencing has the same sequence as a nucleic acid sequence encoding a C region or a complementary strand thereof. Such a primer may be furnished in the apparatus, comprised in a kit, or provided separately. Any TCR or BCR can be amplified in the same manner to achieve unbiasedness by using a primer having the same sequence as a nucleic acid sequence encoding a C region or a complementary strand thereof.

In another embodiment, the single sequencing is characterized in being performed with a common adaptor primer. Such a common adaptor primer may be furnished with the apparatus, comprised in a kit or provided separately. In a preferred embodiment, the common adaptor primer is designed such that the primer has a base length suitable for amplification, is unlikely to have homodimer and intramolecular hairpin structures, and is able to stably form a double strand, and designed not to be highly homologous with all TCR genetic sequences in the database and/or to have the same level of melting temperature (Tm) as the C region specific primer. Further preferably, the common adaptor primer designed not to have homodimer and intramolecular hairpin structures and to have homology with other genes comprising a BCR or TCR is selected. In a specific embodiment, the common adaptor primer is P20EA (SEQ ID NO: 2) and/or P10EA (SEQ ID NO: 3).

In one embodiment, a nucleic acid sequence comprised in a nucleic acid sample provided by the kit of the present invention is unbiasedly amplified, where the amplification is not V region specific amplification. Bias can be further reduced or eliminated compared to a case of performing unbiased amplification by devising a multiplex or the like using a V specific primer.

In one embodiment, the repertoire subjected to analysis of the system of the present invention is the repertoire of a variable region of a BCR, and the nucleic acid sequence is a BCR nucleic acid sequence. BCRs are considered to be prone to having a mutation, especially in a V region. Thus, accurate analysis of a BCR repertoire is difficult with a technology using V region specific amplification. Use of the system of the present invention allows accurate analysis of a BCR repertoire.

In another aspect, the present invention provides a system (analysis system) of analyzing a disease, disorder or condition of the subject, comprising the analysis system of the present invention and means for analyzing the disease, disorder or condition of the subject based on the TCR or BCR repertoire derived based the system. The means of analyzing a disease, disorder or condition of a subject based on a TCR or BCR repertoire derived based on the system of the analysis system of the present invention starts from linking derived read data consisting of read types, number of reads, read frequency, V region, J region, C region CDR3 sequence or the like with clinical information such as disease, disorder, or condition to form a database by using a spreadsheet such as EXCEL. First, for a derived individual read sequence: 1. a TCR having a known function such as NKT or MAIT is searched; 2. existing public database is searched for collation with a TCR or BCR with a known function such as antigen specificity; 3. the constructed database or an existing public database is searched to associate a common sample origin, property or function with a disease, disorder or condition. Next, for a read sequence in a sample: 1. it is clarified whether a specific read frequency increases (clonality increases); 2. examination is carried out to find out whether a specific V chain or J chain usage frequency increases or decreases depending on the onset of a disease or condition of a disorder; 3. examination is carried out to find out whether the length of a CDR3 sequence in a specific V chain increases or decreases depending on the onset of a disease or condition of a disorder; 4. the composition or sequence of a CDR3 region that changes depending on the onset of a disease or condition of a disorder is examined. 5. a read that appears or disappears depending on the onset of a disease or condition of a disorder is searched; 6. a read that increases or decreases depending on the onset of a disease or condition of a disorder is searched; 7. a read that appears or increase/decrease depending on the onset of a disease or condition of a disorder is searched in another sample and associated with a disease, disorder or condition; 8. a diversity index or similarly index is calculated with a statistical analysis software such as ESTIMATES or R (vegan) by using data such as number of samples, read type, or number of reads; and 9. a change in the diversity index or similarity index can be associated with the onset of a disease or condition of a disorder.

In one embodiment, the disease, disorder or condition of the subject that can be analyzed by the analysis system of the present invention includes, but is not limited to, hematological tumor, colorectal cancer, immune status, rheumatoid arthritis, adult T-cell leukemia, T-cell large granular lymphocyte leukemia, idiopathic thrombocytopenic purpura, and the like.

In another aspect, the present invention provides a system (treatment system or prevention system) of treating or preventing the disease, disorder or condition of the subject determined by the analysis system of the present invention, comprising: means for quantitatively associating the disease, disorder or condition of the subject with the TCR or BCR repertoire; and means for selecting means for suitable treatment or prevention from the quantitative association.

The means for quantitatively associating the disease, disorder or condition of the subject with the TCR or BCR repertoire in the system of the present invention can be materialized by the following configuration or the like. That is, this can be materialized by reading out information of a repertoire derived out by the analysis system of the present invention and reading out information related to a disease, disorder or condition of a subject (medical history, disease name, disease type, degree of progression, severity, HLA type, immune status or the like) to form a database by using a spreadsheet such as EXCEL or a software having a database formation feature. Read sequences in a sample are sorted by the number of reads or frequency and ranked. Further, the number of reads is added up by each V region or J region to calculate usage frequency of a V region or usage frequency of a J region. Base on such information: 1. it is clarified whether a specific read frequency increases (clonality increases); 2. examination is carried out to find out whether a specific V chain or J chain usage frequency increases or decreases depending on the onset of a disease or condition of a disorder; 3. examination is carried out to find out whether the length of a CDR3 sequence in a specific V chain increases or decreases depending on the onset of a disease or condition of a disorder; 4. the composition or sequence of a CDR3 region that changes depending on the onset of a disease or condition of a disorder is examined. 5. a read that appears or disappears depending on the onset of a disease or condition of a disorder is searched; 6. a read that increases or decreases depending on the onset of a disease or condition of a disorder is searched; 7. a read that appears or increase/decrease depending on the onset of a disease or condition of a disorder is searched in another sample and associated with a disease, disorder or condition; 8. a diversity index or similarly index is calculated with a statistical analysis software such as ESTIMATES or R (vegan) by using data such as number of samples, read type, or number of reads; and 9. a change in the diversity index or similarity index can be associated with the onset of a disease or condition of a disorder. Means for selecting means for suitable treatment or prevention from the quantitative association can have the following configuration or the like. Specifically, selection can be materialized for this selection means by associating quantitatively presented data with the information from the past or currently available information related to treatment, therapy or prevention to materialize selection of means that improves prognosis.

In one embodiment, the disease, disorder or condition of the subject includes, but is not limited to, hematological tumor, colorectal cancer, immune status, rheumatoid arthritis, adult T-cell leukemia, T-cell large granular lymphocyte leukemia, idiopathic thrombocytopenic purpura, and the like.

(Useful Cell, Peptide, and the Like)

In one aspect, the present invention provides a monoclonal T cell related to T cell large granular lymphocytic leukemia (T-LGL) expressing TCRα comprising TRAV10/TRAJ15/CVVRATGTALIFG (SEQ ID NO: 1450) or a nucleic acid encoding the same and/or TCRβ comprising TRBV29-1/TRBJ2-7/CSVERGGSLGEQYFG (SEQ ID NO: 1500) or a nucleic acid encoding the same.

As shown in the Examples or the like, this specific T cell has a variety of usefulness. For instance, it is demonstrated that TRAV10/TRAJ15/CVVRATGTALIFG (SEQ ID NO: 1450) or a nucleic acid encoding the same in TCRα and/or TRBV29-1/TRBJ2-7/CSVERGGSLGEQYFG (SEQ ID NO: 1500) or a nucleic acid encoding the same in TCRβ can be used as a diagnostic indicator for T cell large granular lymphocytic leukemia (T-LGL). Such a peptide and a nucleic acid encoding the same can be detected by using any known technology in the art. As used herein, "detecting agent" broadly refers to all agents capable of detecting a target of interest (e.g., a peptide, nucleic acid, cell or the like). For instance, for such a method, "detection" or "quantification" of polynucleotide or polypeptide expression can be accomplished by using a suitable method including, for example, an immunological measuring method and measurement of mRNAs, including bond or interaction with a marker detecting agent. Examples of a molecular biological measuring method include northern blot, dot blot, PCR and the like. Examples of an immunological measuring method include ELISA using a microtiter plate, RIA, fluorescent antibody method, luminescence immunoassay (LIA), immunoprecipitation (IP), single radial immunodiffusion (SRID), turbidimetric immunoassay (TIA), western blot, immunohistochemical staining and the like. Further, a quantification method includes ELISA, RIA and the like. Quantification may also be performed by a genetic analysis method using an array (e.g., DNA array, protein array). DNA arrays are outlined extensively in (Ed. by Shujunsha, Saibo Kogaku Bessatsu "DNA Maikuroarei to Saishin PCR ho" [Cellular engineering, Extra issue, "DNA Microarrays and Latest PCR Methods"]). Protein arrays are discussed in detail in Nat Genet. 2002 December; 32 Suppl: 526-32. Examples of a method of analyzing gene expression include, but are not limited to, RT-PCR, RACE, SSCP, immunoprecipitation, two-hybrid system, in vitro translation and the like, in addition to the methods discussed above. Such additional analysis methods are described in, for example, Genomu Kaiseki Jikkenho Nakamura Yusuke Labo Manyuaru [Genome analysis experimental method Yusuke Nakamura Lab Manual], Ed. by Yusuke Nakamura, Yodosha (2002) and the like. The entire descriptions therein is incorporated herein by reference. As used herein, "amount of expression" refers to the amount of polypeptide, mRNA or the like expressed in a cell, tissue or the like of interest. Examples of such an amount of expression include amount of expression of polypeptide of the present invention at a protein level assessed by any suitable method including an immunological measurement method such as ELISA, RIA, fluorescent antibody method, western blot, and immunohistochemical staining by using the antibody of the present invention, and the amount of expression of the polypeptide used in the present invention at an mRNA level assessed by any suitable method including molecular biological measuring method such as northern blot, dot blot, and PCR. "Change in the amount of expression" refers to an increase or decrease in the amount of expression of the polypeptide used in the present invention at a protein level or mRNA level assessed by any suitable method including the above-described immunological measuring method or molecular biological measuring method. A variety of detection or diagnosis based on a marker can be performed by measuring the amount of expression of a certain marker.

The present invention also provides a diagnostic agent for T cell large granular lymphocytic leukemia (T-cell LGL) comprising a detecting agent for TRAV10/TRAJ15/ CVVRATGTALIFG (SEQ ID NO: 1450) or a nucleic acid encoding the same in TCRα and/or a detecting agent for TRBV29-1/TRBJ2-7/CSVERGGSLGEQYFG (SEQ ID NO: 1500) or a nucleic acid encoding the same in TCRβ.

As used herein, "decrease" or "suppression" of activity or expression product (e.g., protein, transcript (RNA or the like)) or synonyms thereof refers to: a decrease in the amount, quality or effect of a specific activity, transcript or protein; or activity that decreases the same.

As used herein, "increase" or "activation" of activity or expression product (e.g., protein, transcript (RNA or the like)) or synonyms thereof refers to: an increase in the amount, quality or effect of a specific activity, transcript or protein; or activity that increases the same.

Thus, it is understood that various agents with activity can be detected or screened by using a regulatory ability such as decrease, suppression, increase or activation of the marker of the present invention as an indicator.

As used herein, "agent" is used broadly and may be any substance or other elements (e.g., energy, radiation, heat, electricity and other forms of energy) as long as the intended objective can be achieved. Examples of such a substance include, but are not limited to, protein, polypeptide, oligopeptide, peptide, polynucleotide, oligonucleotide, nucleotide, nucleic acid (including for example DNAs such as cDNA and genomic DNA, RNAs such as mRNA), polysaccharide, oligosaccharide, lipid, organic small molecule (e.g., hormone, ligand, information transmitting substance, organic small molecule, molecule synthesized by combinatorial chemistry, small molecule that can be used as a medicine (e.g., small molecule ligand and the like) and a composite molecule thereof. Typical examples of an agent specific to a polynucleotide include, but are not limited to, a polynucleotide having complementarity with a certain sequence homology (e.g., 70% or greater sequence identity) to a sequence of the polynucleotide, polypeptide such as a transcription factor that binds to a promoter region and the like. Typical examples of an agent specific to a polypeptide include, but are not limited to, an antibody directed specifically to the polypeptide or a derivative or analog thereof (e.g., single strand antibody), a specific ligand or receptor when the polypeptide is a receptor or ligand, a substrate when the polypeptide is an enzyme and the like.

As used herein, "detecting agent" broadly refers to all agents capable of detecting a target of interest (e.g., normal cells (normal corneal endothelial cells) or transformed cells (e.g., transformed corneal endothelial cells)).

As used herein, "diagnostic agent" broadly refers to all agents capable of diagnosing a condition of interest (e.g., disease or the like).

The detecting agent of the present invention may be a complex or composite molecule in which another substance (e.g., label or the like) is bound to a portion enabling detection (e.g., antibody or the like). As used herein, "complex" or "composite molecule" refers to any construct comprising two or more portions. For instance, when one portion is a polypeptide, the other portion may be a polypeptide or other substances (e.g., sugar, lipid, nucleic acid, other carbohydrate or the like). As used herein, two or more constituent portions of a complex may be bound by a covalent bond or any other bond (e.g., hydrogen bond, ionic bond, hydrophobic interaction, Van der Waals force or the like). When two or more portions are polypeptides, the complex may be called a chimeric polypeptide. Thus, "complex" as used herein includes molecules formed by linking a plurality of types of molecules such as a polypeptide, polynucleotide, lipid, sugar, or small molecule.

As used herein, "interaction" refers, for two substances, to applying a force (e.g., intermolecular force (Van der Waals force), hydrogen bond, hydrophobic interaction, or the like) between one substance and the other substance. Generally, two substances that have interacted are in a conjugated or bound state.

As used herein, the term "bond" refers to a physical or chemical interaction between two substances or between combinations thereof. A bond includes an ionic bond, non-ionic bond, hydrogen bond, Van der Waals bond, hydrophobic interaction and the like. A physical interaction (bond) may be direct or indirect. Indirect physical interaction (bond) is mediated by or is due to an effect of another protein or compound. A direct bond refers to an interaction, which does not occur through or due to an effect of another protein or compound and does not substantially involve another intermediate. The degree of marker expression of the present invention or the like can be measured by measuring a bond or interaction.

Thus, an "agent" (such as detecting agent or the like) that "specifically" interacts (or binds) to a biological agent such as a polynucleotide or a polypeptide as used herein encompasses agents with affinity to the biological agent such as a polynucleotide or polypeptide that is typically similar or higher, preferably significantly (e.g., statistically significantly) higher, than affinity to other unrelated polynucleotide or polypeptide (especially those with less than 30% identity). Such affinity can be measured by, for example, hybridization assay, binding assay or the like.

As used herein, "specific" interaction (or bond) of a first substance or agent with a second substance or agent refers to the first substance or agent interacting with (or binding to) the second substance or agent at a higher level of affinity than to substances or agents other than the second substance or agent (especially other substances or agents in a sample comprising the second substance or agent). Examples of an interaction (or bond) specific to a substance or agent include, but are not limited to, a ligand-receptor reaction, hybridization in a nucleic acid, antigen-antibody reaction in a protein, enzyme-substrate reaction and the like, and when both a nucleic acid and a protein are involved, a reaction between a transcription factor and a binding site of the transcription factor and the like, protein-lipid interaction, nucleic acid-lipid interaction and the like. Thus, when substances or agents are both nucleic acids, a first substance or agent "specifically interacting" with a second substance or agent encompasses the first substance or agent having at least partial complementarity to the second substance or agent. Further, examples of a first substance or agent "specifically" interacting with (or binding to) a second substance or agent when substances or agents are both proteins includes, but are not limited to, interaction by an antigen-antibody reaction, interaction by a receptor-ligand reaction, enzyme-substrate interaction and the like. When two types of substances or agents include a protein and a nucleic acid, a first substance or agent "specifically" interacting with (or binding to) a second substance or factor encompasses an interaction (or a bond) between a transcription factor and a binding region of a nucleic acid molecule targeted by the transcription factor.

As used herein, "antibody" broadly encompasses a polyclonal antibody, monoclonal antibody, multispecific antibody, chimeric antibody, and anti-idiotype antibody, and a fragment thereof such as Fv fragment, Fab' fragment, F(ab')$_2$ and Fab fragment, and other conjugates or functional equivalents produced by recombination (e.g., chimeric antibody, humanized antibody, multifunctional antibody, bispecific or oligospecific antibody, single chain antibody, scFv, diabody, and sc(Fv)$_2$ (single chain (Fv)$_2$), and scFv-Fc). Furthermore, such an antibody may be covalently bonded or recombinantly fused to an enzyme, such as alkaline phosphatase, horseradish peroxidase, a galactosidase or the like. The antibodies to various reads used in the present invention may be of any origin, type, shape or the like which bind to their respective specific read. Specifically, known antibodies such as a non-human animal antibody (e.g., mouse antibody, rat antibody, and camel antibody), human antibody, chimeric antibody and humanized antibody can be used. The present invention can use a monoclonal or polyclonal antibody, but a monoclonal antibody is preferred. It is preferred that a bond of an antibody to a specific read is a specific bond.

As used herein, "antigen" refers to any substrate that can be specifically bound by an antibody molecule. As used herein, "immunogen" refers to an antigen that can initiate lymphocyte activation which leads to an antigen specific immune response. As used herein, "epitope" or "antigen determinant" refers to a site in an antigen molecule to which an antibody or a lymphocyte receptor binds. A method of determining an epitope is well known in the art. Such an epitope can be determined by those skilled in the art by using a well-known and conventional technique when a primary sequence of an amino acid or a nucleic acid is provided.

As used herein, "means" refers to anything that can be a tool for accomplishing an objective (e.g., detection, diagnosis, therapy).

For an antibody used herein, it is understood that an antibody with any specificity may be used as long as false positive reactions are reduced. Thus, an antibody used in the present invention may be a polyclonal antibody or a monoclonal antibody.

The detecting agent, diagnostic agent or other medicines of the present invention can be in a form of a probe and a primer. The probe and the primer of the present invention can specifically hybridize to a specific read. As described herein, expression of a specific read is, for example, an indicator of whether there is a colorectal cancer and is useful as an indicator for the severity of a disease.

As used herein, "(nucleic acid) primer" refers to a substance required for initiating a reaction of a polymeric compound to be synthesized in a polymer synthesizing enzyme reaction. A synthetic reaction of a nucleic acid molecule can use a nucleic acid molecule (e.g., DNA, RNA or the like) complementary to a portion of a sequence of a polymeric compound to be synthesized. A primer can be used herein as a marker detecting means.

Examples of a nucleic acid molecule generally used as a primer include those having a nucleic acid sequence with a length of at least 8 contiguous nucleotides, which is complementary to a nucleic acid sequence of a gene of interest (e.g., marker of the present invention). Such a nucleic acid sequence may be a nucleic acid sequence with a length of preferably at least 9 contiguous nucleotides, more preferably at least 10 contiguous nucleotides, still more preferably at least 11 contiguous nucleotides, at least 12 contiguous nucleotides, at least 13 contiguous nucleotides, at least 14 contiguous nucleotides, at least contiguous nucleotides, at least 16 contiguous nucleotides, at least 17 contiguous nucleotides, at least contiguous nucleotides, at least 19 contiguous nucleotides, at least 20 contiguous nucleotides, at least contiguous nucleotides, at least 30 contiguous nucleotides, at least 40 contiguous nucleotides, or at least 50 contiguous nucleotides. A nucleic acid sequence used as a probe comprises a nucleic acid sequence that is at least 70% homologous, more preferably at least 80% homologous, still more preferably at least 90% homologous, or at least 95% homologous to the aforementioned sequence. A sequence suitable as a primer may vary depending on the property of a sequence intended for synthesis (amplification). However, those skilled in the art are capable of designing an appropriately primer in accordance with an intended sequence. Design of such a primer is well known in the art, which may be performed manually or by using a computer program (e.g., LASERGENE, PrimerSelect, or DNAStar).

The primers according to the present invention can be used as a primer set consisting of two or more types of the primers.

The primers and primer set according to the present invention can be used as primers and primer set in accordance with a common method in a known method of detecting a gene of interest by utilizing a nucleic acid amplification method such as PCR, RT-PCR, real-time PCR, in situ PCR, or LAMP.

As used herein, "probe" refers to a substance that can be means for search, which is used in a biological experiment such as in vitro and/or in vivo screening. Examples thereof include, but are not limited to, a nucleic acid molecule comprising a specific base sequence, a peptide comprising a specific amino acid sequence, a specific antibody, a fragment thereof and the like. As used herein, a probe can be used as marker detecting means.

A nucleic acid molecule generally used as a probe includes those having a nucleic acid sequence with a length of at least 8 contiguous nucleotides, which is homologous or complementary to a nucleic acid sequence of a gene of interest. Such a nucleic acid sequence may be a nucleic acid sequence with a length of preferably at least 9 contiguous nucleotides, more preferably at least 10 contiguous nucleotides, still more preferably at least 11 contiguous nucleotides, at least 12 contiguous nucleotides, at least 13 contiguous nucleotides, at least 14 contiguous nucleotides, at least 15 contiguous nucleotides, at least contiguous nucleotides, at least 25 contiguous nucleotides, at least 30 contiguous nucleotides, at least contiguous nucleotides, or at least 50 contiguous nucleotides. A nucleic acid sequence used as a probe comprises a nucleic acid sequence that is at least about 70% homologous, more preferably at least about 80% homologous, still more preferably at least about 90% homologous, or at least about 95% homologous with the aforementioned sequence.

In one embodiment, the detecting agent of the present invention may be labeled. Alternatively, the detecting agent of the present invention may be bound to a tag.

As used herein, "label" refers to an entity (e.g., substance, energy, electromagnetic wave or the like) for distinguishing a molecule or substance of interest from others. Such a method of labeling includes RI (radioisotope) method, fluorescence method, biotin method, chemiluminescent method and the like. When a plurality of markers of the present invention or agents or means for capturing the same are labeled by a fluorescence method, labeling is performed with labeling substances having different fluorescent emission maximum wavelengths. It is preferable that the difference in fluorescent emission maximum wavelengths is 10 nm or greater. When labeling a ligand, any label that does not affect the function can be used. However, Alexa™ Fluor is desirable as a fluorescent substance. Alexa™ Fluor is a water-soluble fluorescent dye obtained by modifying coumarin, rhodamine, fluorescein, cyanine or the like. This is a series compatible with a wide range of fluorescence wavelengths. Relative to other fluorescent dyes for the corresponding wavelength, Alexa™ Fluor is very stable, bright and has a low level of pH sensitivity. Combinations of fluorescent dyes with fluorescence maximum wavelength of 10 nm or greater include a combination of Alexa™ 555 and Alexa™ 633, combination of Alexa™ 488 and Alexa™ 555 and the like. When a nucleic acid is labeled, any substance can be used that can bind to a base portion thereof. However, it is preferable to use a cyanine dye (e.g., Cy3, Cy5 or the like of the CyDye™ series), rhodamine 6G reagent, N-acetoxy-N2-acetylaminofluorene (AAF), AAIF (iodine derivative of AAF) or the like. Examples of a fluorescent substance with a difference in fluorescent emission maximum wavelengths of nm or greater include a combination of Cy5 and a rhodamine 6G reagent, a combination of Cy3 and fluorescein, a combination of a rhodamine 6G reagent and fluorescein and the like. The present invention can utilize such a label to alter a subject of interest to be detectable by the detecting means to be used. Such alteration is known in the art. Those skilled in the art can appropriately carry out such a method in accordance with the label and subject of interest.

As used herein, "tag" refers to a substance for distinguishing a molecule by a specific recognition mechanism such as receptor-ligand, or more specifically, a substance serving the role of a binding partner to bind a specific substance (e.g., having a relationship such as biotin-avidin or biotin-streptavidin). A tag can be encompassed in the scope of "label". Accordingly, a specific substance to which a tag is bound can distinguish the specific substance by a contact with a substrate, to which a binding partner of a tag sequence is bound. Such a tag or label is known in the art. Typical tag sequences include, but are not limited to, myc tag, His tag, HA, Avi tag and the like. Such a tag may be bound to the marker or marker detecting agent of the present invention.

The method of the present invention can be carried out by contacting the detecting agent or diagnostic agent of the present invention with a sample of interest to measure whether there is a target read of interest or a gene of the lead in the sample, or the level or amount thereof.

As used herein, "contact(ed)" refers to physically adjoin, either directly or indirectly, a substance to a polypeptide or a polynucleotide that can function as the marker, detecting agent, diagnostic agent, ligand or the like of the present invention. A polypeptide or polynucleotide can be included in many buffer solutions, salts, solutions and the like. Contact includes placing a compound in, for example, a beaker, microtiter plate, cell culture flask, microarray (e.g., gene chip) or the like comprising a polypeptide encoding a nucleic acid molecule or a fragment thereof.

In another aspect, the present invention provides a peptide which is a novel invariant TCR, comprising any one of the sequences set forth in SEQ ID NOs: 1627-1647. Such a peptide can be used as an invariant and applied as various indicators (e.g., indicator of a disease or the like).

In still another aspect, the present invention provides a TCR peptide having a mucosal-associated invariant T (MAIT) cell, comprising a sequence selected from the group consisting of SEQ ID NOs 1648-1651, 1653-1654, 1666-1667, 1844-1848, and 1851 or a nucleic acid encoding such a peptide. Such a peptide and nucleic acid can be used as a mucosal-associated invariant T (MAIT) and applied as various indicators (e.g., indicator of a disease or the like). In one specific embodiment, a peptide which is a TCR having a mucosal-associated invariant T (MAIT) of the present invention or a nucleic acid encoding such a peptide can be used as a diagnostic indicator of colorectal cancer.

In another aspect, the present invention provides a peptide, which is a TCR having a natural killer T (NKT) cell comprising the sequence set forth in SEQ ID NO: 1668 and a nucleic acid encoding the peptide. In one specific embodiment, the peptide, which is a TCR having a natural killer T (NKT) cell and a nucleic acid encoding the peptide can be used as a diagnostic indicator of colorectal cancer.

In another aspect, the present invention provides a colorectal cancer-specific peptide comprising a sequence selected from the group consisting of SEQ ID NOs: 1652, 1655-1665, 1669-1843, 1849-1850, and 1852-1860 and a nucleic acid encoding the same. In one specific embodiment, such a peptide and nucleic acid encoding the same can be used as a diagnostic indicator of colorectal cancer.

In a further aspect, the present invention provides a colorectal cancer specific peptide, comprising a sequence selected from the group consisting of SEQ ID NOs: 1861-

1865 and 1867-1909 and a nucleic acid encoding the same. In one specific embodiment, such a peptide and nucleic acid encoding the same can be used as a diagnostic indicator of colorectal cancer.

In another aspect, the present invention provides a cell population inducing a T cell at a high frequency, T cell cell line, or recombinantly expressed T cell having a peptide comprising a sequence selected from the group consisting of SEQ ID NOs: 1652, 1655-1665, 1669-1843, 1849-1850, and 1852-1860 and SEQ ID NOs: 1861-1865 and 1867-1909 or a nucleic acid sequence encoding the peptide. A cell population, cell line, cell, colorectal cancer specific TCR peptide or nucleic acid encoding said peptide is useful in diagnosis or therapy. For diagnosis, colorectal cancer can be discovered, or pathological condition or prognosis can be predicted, by examining if the sequence is only in colorectal cancer patients, the sequence is observed more in colorectal cancer patients, or the sequence accumulates in cancer tissue of the same patient. For therapy of colorectal cancer, it is possible to utilize a cell population inducing a T cell at a high frequency with a colorectal cancer specific sequence, a T cell cell line with a colorectal cancer specific sequence, or a T cell (lymphocyte) artificially made to express a colorectal cancer specific sequence (As reference documents, see 1: Uttenthal B J, Chua I, Morris E C, Stauss H J. Challenges in T cell receptor gene therapy. J Gene Med. 2012 June; 14(6): 386-99. doi: 10.1002/jgm.2637. Review. PubMed PMID: 22610778; 2: Linnemann C, Schumacher T N, Bendle G M. T-cell receptor gene therapy: critical parameters for clinical success. J Invest Dermatol. 2011 September; 131(9): 1806-16.doi: 10.1038/jid.2011.160. Epub 2011 Jun. 16. Review. PubMed PMID: 21677669; 3: Lagisetty K H, Morgan R A. Cancer therapy with genetically-modified T cells for the treatment of melanoma. J Gene Med. 2012 June; 14(6): 400-4. doi: 10.1002/jgm.2636. Review. PubMed PMID: 22610729). Thus, the present invention provides a therapeutic agent or a prophylactic agent for colorectal cancer, comprising the above-described cell population, T cell cell line, or T cell.

(Application) The present invention can be used to calculate a base sequence (read) of a TCR or BCR gene identified by a large-scale sequencing and a frequency of appearance thereof with a software to draw a list, a distribution or a graph. Based on such information, a change in a repertoire is detected by using the following various indicators. Association with a disease or disorder can be found based on such a change.

In one aspect, the present invention provides a method of detecting a usage frequency of a V gene by using the analysis method or the analysis system of the present invention. A V gene of each read can be identified to calculate the percentage of each V gene with the respect to the entire TCR or BCR genes. It is possible to find an increase or decrease in usage frequency of V associated with a disease or pathological condition.

In another aspect, the present invention provides a method of detecting a usage frequency of a J gene by using the analysis method or the analysis system of the present invention. A J gene of each read can be identified to calculate the percentage of each J gene with the respect to the entire TCR or BCR genes. It is possible to find an increase or decrease in usage frequency of J associated with a disease or pathological condition.

In another aspect, the present invention provides a method of detecting a usage frequency of subtype frequency analysis (BCR) by using the analysis method or the analysis system of the present invention. It is possible to calculate the frequency of presence of subtypes IgA1, IgA2, IgG1, IgG2, IgG3, and IgG4 based on sequencing of a C region. It is possible to find an increase or decrease in a specific subtype associated with a disease or pathological condition.

In another aspect, the present invention provides a method of analyzing a pattern of CDR3 sequence lengths by using the analysis method or the analysis system of the present invention. A CDR3 base sequence length of each read can be calculated to find the distribution thereof. A normal distribution-like peak pattern is exhibited from normal TCRs or BCRs. It is possible to find the association with a disease or pathological condition by detecting a peak deviating away from a normal distribution.

In another aspect, the present invention provides a method of analyzing clonality of a TCR or a BCR by using the analysis method or the analysis system of the present invention. Reads having the same sequence are classified based on V sequence, J sequence, and CDR3 sequence of each read to calculate the number of copies thereof. It is possible to find a lead present at a high frequency by calculating the percentage of the number of copies of each lead relative to the number of all reads. The degree of clonality is assessed by sorting the reads in descending order by the frequency of appearance and comparing the percentage or number of reads that are present at a high frequency with a normal sample. A change in TCR or BCR clonality associated with a disease or pathological condition is examined therewith. The degree of clonality can be used particularly in detecting a leukemic cell or the like.

In another aspect, the present invention provides a method of extracting an overlapping read by using the analysis method or the analysis system of the present invention. A read of a sample classified by a specific disease, disease type, pathological condition, tissue, genotype (HLA or the like) is searched to extract overlapping TCR or BCR reads between samples. It is possible to find a TCR or BCR gene associated with a condition of a disease or disorder therewith. It is possible to identify a disease specific T cell involved in the pathology of an autoimmune disease, a B cell producing a disease associated antibody, a cancer specific T cell attacking a cancer cell or the like.

In another aspect, the present invention provides a method of searching for a disease specific TCR or BCR clone by using the analysis method or the analysis system of the present invention. It is possible to predict the progression or amelioration in a pathological condition or the onset of a disease by searching for a TCR or BCR read associated with a specific condition of a disorder or disease in a test sample and revealing the appearance or disappearance, or increase or decrease thereof.

In another aspect, the present invention provides a method of analyzing a subject with a diversity index by using the analysis method or the analysis system of the present invention. Alternatively, the present invention provides a method of assisting analysis on a subject with a diversity index by using the analysis method or the analysis system of the present invention. A read sequence identified based on a CDR3 sequence is counted and the number of read types and number of individuals are calculated to form an index for diversity of a TCR or BCR repertoire. The Shannon-Wiener's diversity index (H'), Simpson's diversity index ($\lambda$, 1−$\lambda$, or 1/$\lambda$), Pielou's evenness index (J'), Chao1 index or the like is used to assess diversity by comparison with a normal sample. The index can be utilized as an indicator for measuring a degree of recovery of an immune system after bone marrow transplantation. Further, the index can be utilized as an indicator for detecting abnormality in an immune system cell accompanied by hematopoietic tumor.

In one embodiment, a method of analyzing a subject with a diversity index uses the diversity index as an indicator for measuring a degree of recovery of an immune system after bone marrow transplantation or as an indicator for detecting abnormality in a cell of the immune system accompanied by hematopoietic tumor. Such analysis using a diversity index was difficult with a conventional system.

Various diversity indices can be calculated by using an EXCEL spreadsheet or a software such as ESTIMATES (Colwell, R. K. et al. Journal of Plant Ecology 5: 3-21) or R package (vegan) from data for the number of samples, read types, or the number of reads. The Shannon-Wiener's diversity index (H'), Simpson's diversity index ($\lambda$, 1-$\lambda$, or 1/$\lambda$), Pielou's evenness index (J') and Chao1 index are found by the mathematical equations shown below. N: total number of reads, $n_i$: number of reads in read i Shannon-Weaver index H'

$$H' = -\sum_{i=1}^{S} \frac{n_i}{N} \ln \frac{n_i}{N}$$ [Numeral 1]

Simpson's index $\lambda$ $$1 - \lambda = 1 - \sum_{i=1}^{S} \left( \frac{n_i(n_i - 1)}{N(N - 1)} \right)$$ [Numeral 2]

Inverse Simpson's index $$\frac{1}{\lambda}$$ [Numeral 3]

Pielou's J $$J = \frac{H'}{\log S}$$ [Numeral 4]

$S_{Chao1} S_{obs}$: total number of read types, $F_1$: singleton read, $F_2$: doubleton read $$S_{Chao1} = S_{obs} - \left( \frac{n-1}{n} \right) \frac{F_1(F_1 - 1)}{2(F_2 + 1)}$$ [Numeral 5]

In another aspect, the present invention is a method of analyzing a subject with a similarity index by using the analysis method or the analysis system of the present invention. Alternatively, the present invention provides a method of assisting analysis on a subject with a similarly index by using the analysis method or the analysis system of the present invention. The number of individuals and the number of types of read sequences identified based on a CDR3 sequence are calculated to find the degree of similarly of a TCR or BCR repertoire between samples to be compared. The Morisita-Horn index, Kimoto's C$\pi$ index, or Pianka's $\alpha$ index is used to find a degree of similarly between samples. Such an index can be utilized in the assessment of a degree of similarity of repertoires between matching and mismatching HLA types, assessment of a degree of similarly of repertoires between a recipient and a donor after bone marrow transplantation.

In one embodiment, the similarity index is used as assessment of a degree of similarity of repertoires between matching and mismatching HLA types, or as assessment of a degree of similarly of repertoires between a recipient and a donor after bone marrow transplantation. Such analysis using a similarity index was difficult with a conventional system. Various similarity indices can be calculated with ESTIMATES (Colwell, R. K. et al. Journal of Plant Ecology 5: 3-21) or R package (vegan) by using the following mathematical equations. The Morisita-Horn index, Kimoto's C$\pi$ index, and Pianka's $\alpha$ index are found by the mathematical equations shown below.

Morisita-Horn index, $X_i$: number of times read i appear in all X reads from one of the samples, $y_i$: number of times read i appear in all Y reads from the other sample, S: number of unique reads.

$$C_{MH} = \frac{2\sum_{i=1}^{S} x_i y_i}{\left( \frac{\sum_{i=1}^{S} x_i^2}{X^2} + \frac{\sum_{i=1}^{S} y_i^2}{Y^2} \right) XY}$$ [Numeral 6]

Kimoto's C$\pi$ index $$C_\pi = \frac{2\sum_{i=1}^{S} x_i y_i}{\left( \sum_{i=1}^{S} p_{xi}^2 + \sum_{i=1}^{S} p_{yi}^2 \right) XY}$$ [Numeral 7]

$$p_{xi} = \frac{x_i}{X}, \quad p_{yi} = \frac{y_i}{Y}$$ [Numeral 7-1]

Pianka's $\alpha$ index $$\alpha = \frac{\sum_{i=1}^{S} p_{xi} p_{yi}}{\sqrt{\sum_{i=1}^{S} p_{xi}^2 \sum_{i=1}^{S} p_{yi}^2}}$$ [Numeral 8]

The present invention can use next generation sequencing techniques to prepare a sample for quantitative analysis of a repertoire of a variable region of a T receptor (TCR) or a B cell receptor (BCR). Such sequencing techniques can obtain a million or more reads from a sample at a reasonable cost. Even a genotype that exists at a low frequency of 1/1,000,000 or less can be detected by using these techniques in a specific and unbiased manner. An unbiased amplification method for amplifying all different types of sequences of a specific portion of a gene or a transcript from a sample derived from a DNA of blood, bone marrow or the like is achieved.

<Cancer Idiotype Peptide Sensitization Immune Cell Therapeutic Method>

In one aspect, the present invention provides a method of preparing a composition for use in a cancer idiotype peptide sensitization immune cell therapeutic method to a subject. The method comprises (1) analyzing a T cell receptor (TCR)

or B cell receptor (BCR) repertoire of the subject by the repertoire analysis method of the present invention or the repertoire analysis system of the present invention; (2) determining a TCR or BCR derived from a cancer cell of the subject based on a result of the analysis, wherein the determining is done by selecting a high ranking sequence in a frequency of presence ranking of a TCR or BCR gene derived from the cancer cell of the subject as the TCR or BCR derived from the cancer cell; (3) determining an amino acid sequence of a candidate HLA test peptide based on the determined TCR or BCR derived from cancer, wherein the determining is performed based on a score calculated by using an HLA binding peptide prediction algorithm; and (4) synthesizing the determined peptide. In this regard, a synthesized peptide can be used in a cancer idiotype peptide sensitization immune cell therapeutic method. In some cases, this method is called a "cancer idiotype peptide sensitization immune cell therapeutic method" herein.

A cancer idiotype peptide sensitization immune cell therapeutic method can be implemented in clinical practice by using the following specific procedures. In short, for example, (1) a peripheral blood cell of a cancer patient suffering from hematological tumor can be collected and lymphocyte cells can be separated to subsequently implement the repertoire analysis method of the present invention, and a cancer idiotype peptide sensitization immune cell therapeutic method can be performed with the use thereof.

In another embodiment, the repertoire analysis method of the present invention can be implemented for a TCR in case of T cell based tumor or for a BCR in case of B cell based tumor. Subsequently, a high ranking sequence in a frequency of presence ranking of a TCR or BCR gene is selected as the TCR or BCR derived from the cancer cell. A peptide that binds to a human leukocyte antigen (HLA) of the cancer patient determined separately from a sequence comprising a CDR3 region of the TCR or BCR gene is predicted by using an HLA binding peptide prediction program (any known program can be used as further explained herein). In addition, an HLA binding peptide is synthesized by a peptide synthesizer and the following is subsequently performed. For a tailor-made peptide sensitization CTL therapeutic method, it is possible to collect peripheral blood mononuclear cells from a patient and culture a mixture of the mononuclear cells or antigen presenting cells from the patient and a CD8$^+$ T cell added with the peptide to apply a stimulation with an antigen peptide.

For a tailor-made peptide sensitization CTL therapeutic method, a CTL therapeutic method can be administered by introducing the peptide stimulated lymphocyte cell into the patient.

Alternatively, another method of a tailor-made peptide sensitization DC vaccine therapeutic method can be materialized by collecting a peripheral blood mononuclear cell of a patient, separating a mononuclear cell, inducing differentiation into a dendritic cell (DC) in the presence of a differentiation inducing factor, adding the peptide and culturing the mixture, and introducing the peptide sensitization dendritic cell into the patient to administer dendritic cell therapy.

A cancer idiotype peptide sensitization immune cell therapeutic method can be used in patients with hematologic cancer such as acute myeloid leukemia and related precursor cell neoplasm, lymphoblastic leukemia/lymphoma, lymphoblastic leukemia/lymphoma, chronic lymphocytic leukemia/small lymphocytic lymphoma, B-cell prolymphocytic leukemia, hairy cell leukemia, T-cell prolymphocytic leukemia, T-cell large granular lymphocyte leukemia, and adult T cell leukemia/lymphoma, diseases similar to leukemia such as multiple myeloma and myelodysplastic syndrome, autoimmune diseases such as rheumatoid arthritis, systemic lupus erythematosus, and type I diabetes, and various infections, as well as for patients with terminal cancer, refractory autoimmune disease or severe infection. In particular, it is problematic for an antibody therapeutic method targeting a tumor cell or the like when a target antigen is not expressed on a tumor cell or a target antigen is also expressed on a normal cell. In comparison thereto, a therapeutic method with higher specificity and fewer side effects is expected because a sequence specific to a tumor cell is selected and utilized.

In one embodiment, the candidate HLA test peptide of the step (3) in the present invention is determined by using BIMAS, SYFPEITHI, RANKPEP or NetMHC.

In another embodiment, the present invention comprises, after the step (4) in the present invention, the step of: mixing the peptide, an antigen presenting cell or a dendritic cell derived from the subject, and a CD8$^+$ T cell derived from the subject and culturing the mixture. This is also called an improved CTL method.

For example, unlike the existing broad T cell activation by an anti-CD3 antibody or IL-2, antigen specificity is imparted to a CD8$^+$ T cell utilizing an antigen peptide such that therapy with higher specificity and fewer side effect can be expected in the improved CTL method. Further, the method is characterized in that a higher therapeutic effect can be expected because an individualized peptide created based on the information obtained from a tumor cell of the patient is used.

An improved CTL method can be used in, for example, patients with hematologic cancer such as acute myeloid leukemia and related precursor cell neoplasms, lymphoblastic leukemia/lymphoma, T lymphoblastic leukemia/lymphoma, chronic lymphocytic leukemia/small lymphocytic lymphoma, B-cell prolymphocytic leukemia, hairy cell leukemia, T-cell prolymphocytic leukemia, T-cell large granular lymphocyte leukemia, and adult T cell leukemia/lymphoma, diseases similar to leukemia such as multiple myeloma and myelodysplastic syndrome, autoimmune diseases such as rheumatoid arthritis, systemic lupus erythematosus, and type I diabetes, and various infections, as well as for terminal cancer patients and patients with a refractory autoimmune disease or severe infection.

In another embodiment, the present invention comprises, after the step (4) of the present invention, the step of: mixing the peptide with a dendritic cell derived from the subject and culturing the mixture. This is also called a DC vaccine therapy.

For example, since an individualized peptide is created based on the sequence information obtained from a tumor cell derived from the patient in DC vaccine therapy, such therapy does not act on a normal cell but act more specifically to a tumor cell such that a high therapeutic effect can be expected. Since a peptide is used as an antigen, unlike proteins, there is an advantage in being able to readily perform chemical synthesis.

DC vaccine therapy can be used in, for example, hematologic cancer such as acute myeloid leukemia and related precursor hematologic neoplasms, lymphoblastic leukemia/lymphoma, T lymphoblastic leukemia/lymphoma, chronic lymphocytic leukemia/small lymphocytic lymphoma, B-cell prolymphocytic leukemia, hairy cell leukemia, T-cell prolymphocytic leukemia, T-cell large granular lymphocyte leukemia, and adult T cell leukemia/lymphoma, diseases similar to leukemia such as multiple myeloma and myelodysplastic syndrome, autoimmune diseases such as rheumatoid arthritis, systemic lupus erythematosus, and type I diabetes, and patients with various infections, as well as for patients with terminal cancer, a refractory autoimmune disease or severe infection.

In another embodiment, the present invention comprises, after the step (4) of the present invention, the steps of: mixing the peptide, the antigen presenting cell or the dendritic cell derived from the subject and a CD8$^+$ T cell derived from the subject and culturing the mixture to produce a CD8$^+$ T cell-dendritic cell/antigen presenting cell-peptide mixture; and mixing the peptide with the dendritic cell derived from the subject and culturing the mixture to produce a dendritic cell-peptide mixture. This is also called a patient autoimmune cell therapeutic method.

For example, CD8$^+$ T cell is stimulated and activated with a peptide derived from the patient as in a CTL therapeutic method and peptide sensitization of a dendritic cell is performed in a patient autoimmune cell therapeutic method. Such a therapeutic method is characterized in that a synergistic effect of a sustained effect due to the dendritic cell utilized as the antigen presenting cell and an acute effect due to CTL imparting specificity can be expected by introducing both the dendritic cell and the CD8+ cell derived from the patient into the patient.

A patient autoimmune cell therapeutic method can be used in, for example, patients with hematologic cancer (leukemia etc) such as acute myeloid leukemia and related precursor cell neoplasms, lymphoblastic leukemia/lymphoma, T lymphoblastic leukemia/lymphoma, chronic lymphocytic leukemia/small lymphocytic lymphoma, B-cell prolymphocytic leukemia, hairy cell leukemia, T-cell prolymphocytic leukemia, T-cell large granular lymphocyte leukemia, and adult T cell leukemia/lymphoma, diseases similar to leukemia such as multiple myeloma and myelodysplastic syndrome, autoimmune diseases such as rheumatoid arthritis, systemic lupus erythematosus, and type I diabetes, and various infections, as well as for patients with terminal cancer, a refractory autoimmune disease or severe infection.

In another aspect, the present invention provides a method of applying a cancer idiotype peptide sensitization immune cell therapeutic method to a subject. The method comprises (1) analyzing a T cell receptor (TCR) or B cell receptor (BCR) repertoire of the subject by the repertoire analysis method of the present invention or the repertoire analysis system of the present invention; (2) determining a TCR or BCR derived from a cancer cell of the subject based on a result of the analysis, wherein the determining is done by selecting a high ranking sequence in a frequency of presence ranking of a TCR or BCR gene derived from the cancer cell of the subject as the TCR or BCR derived from the cancer cell; (3) determining an amino acid sequence of a candidate HLA test peptide based on the determined TCR or BCR derived from cancer, wherein the determining is performed based on a score calculated by using an HLA binding peptide prediction algorithm; (4) synthesizing the determined peptide; and optionally (5) administering therapy by using the synthesized peptide. The method encompasses both a method of manufacturing a therapeutic agent and a method of therapy itself. When excluding a medical act, the method can be completed before step (5).

In a preferred embodiment, the candidate HLA test peptide of the step (3) is determined by using BIMAS, SYFPEITHI, RANKPEP or NetMHC in the present invention.

BIMAS is a program for estimating HLA peptide bond provided at www dot-bimas dot cit dot nih dot gov/.

SYFPEITHI is a search engine and a database for MHC ligands and peptide motifs provided at www dot-syfpeithi dot de/.

RANKPEP is a program for predicting a peptide bond to class I and class II MHC molecules, provided at http colon//imed dot med dot ucm dot es/Tools/rankpep dot html.

NetMHC is a program server for predicting binding of a peptide to numerous HLA alleles, provided at www dot cbs dot dtu dot dk/services/NetMHC/.

In a preferred embodiment, the present invention comprises, after the step (4), the steps of: mixing the peptide, an antigen presenting cell or a dendritic cell derived from the subject, and a CD8$^+$ T cell derived from the subject and culturing the mixture; and administering the mixture after culturing to a patient as an improved CTL method.

In a preferred embodiment, the present invention comprises, after the step (4), the steps of: mixing the peptide with the dendritic cell derived from the subject and culturing the mixture; and administering the cultured mixture to a patient as a DC vaccination therapeutic method.

In a preferred embodiment, the present invention comprises, after the step (4), the steps of: mixing the peptide, the antigen presenting cell or the dendritic cell derived from the subject and a CD8$^+$ T cell derived from the subject and culturing the mixture to produce a CD8$^+$ T cell-dendritic cell/antigen presenting cell-peptide mixture; mixing the peptide with the dendritic cell derived from the subject and culturing the mixture to produce a dendritic cell-peptide mixture; and administering the CD8$^+$ T cell-dendritic cell/antigen presenting cell-peptide mixture and the dendritic cell-peptide mixture to a patient as a patient autoimmune cell therapeutic method.

<Isolation of Tailor-Made Cancer Specific T Cell Receptor Gene, Isolation of Cancer Specific TCR Gene by In Vitro Antigen Stimulation>

In another aspect, the present invention provides a technique for isolation of a tailor-made cancer specific T cell receptor gene or isolation of a cancer specific TCR gene by in vitro antigen stimulation. Thus, the present invention provides a method of preparing an isolated cancer specific TCR gene by an in vitro antigen stimulation, comprising: (A) mixing an antigen peptide or antigen protein derived from a subject or the peptide determined in the "Cancer idiotype peptide sensitization immune cell therapeutic method" of the present invention or a lymphocyte derived from the subject, an inactivated cancer cell derived from the subject, and a T lymphocyte derived from the subject and culturing the mixture to produce a tumor specific T cell; (B) analyzing a TCR of the tumor specific T cell by the repertoire analysis method of the present invention or the repertoire analysis system of the present invention; and (C) isolating a desired tumor specific T cell based on a result of the analyzing. Such preparation of an isolated cancer specific TCR gene by an in vitro antigen stimulation can be implemented by using any well-known technology in the art once the gene information is obtained. Such an isolated tailor-made cancer specific T cell receptor gene and a cancer specific TCR gene can be used to treat or prevent a variety of cancers.

Such an isolated tailor-made cancer specific T cell receptor gene and cancer specific TCR gene can be implemented in clinical practice by using the following specific procedures.

In one embodiment, therapy using an isolated tailor-made cancer specific T cell receptor gene and cancer specific TCR gene can be materialized, for example, as follows: (1) tumor cells are extracted from a cancer patient; (2) after crushing the tumor cells from the patient, cells are separated into single cells and inactivated by radiation irradiation or chemical treatment with mitomycin C or the like; (3) peripheral blood cells are separated from whole blood of the cancer patient; (4) an RNA is extracted from cells, with some of the peripheral blood cells as an untreated control sample; (5) the inactivated tumor cells and the peripheral blood cells are mixed and cultured to activate and proliferate the tumor specific T cells; (6) after activation, an RNA is extracted from the cells by collecting the peripheral blood cells as a sample after stimulation; (7) the repertoire analysis method of the present invention is implemented on the RNA samples extracted in (4) and (6); (8) TCR genes that have greatly increased with a stimulation sample relative to a control sample are extracted and ranked, and then high ranking TCRα and TCRβ genes are selected; (9) the full-length TCRα and TCRβ genes are cloned and introduced into a retroviral vector for gene expression; (10) a gene introducing virus is created from the TCRα and TCRβ gene expression retroviral vector; (11) lymphocytes collected from the patient are infected independently and successively with TCRα and TCRβ for transfection, or a gene expression retroviral vector comprising both TCRα and TCRβ genes is created to transform both genes at once; (12) expression of TCRα/TCRβ heterodimers on a cell surface is confirmed; and (13) a tumor specific patient lymphocyte expressing TCRα/TCRβ of interest is introduced into the cells of the patient.

Specifically, the TCR or BCR determined by the method described in the "Cancer idiotype peptide sensitization immune cell therapeutic method" can be used as an antigen or peptide, for example, for hematological tumor in the embodiments of the present invention. In this regard, any cancer antigen or inactivated cancer tissue from a patient is presumed, where the following can be utilized as a typical method: a method of mixing any antigen protein or any antigen peptide, T lymphocyte, and antigen presenting cell; a method of mixing a lymphocyte from a subject and an inactivated cancer cell from the subject; and a method of mixing an antigen-resenting cell, T lymphocyte, and peptide derived from a TCR or BCR determined by the repertoire analysis provided in "Cancer idiotype peptide sensitization immune cell therapeutic method".

Thus, in one embodiment, the step (A) in the present invention is a step of mixing the inactivated cancer cell derived from the subject and the antigen peptide or antigen protein derived from the subject with the T lymphocyte derived from the subject and culturing the mixture to produce a tumor specific T cell.

In a further embodiment, the step (A) in the present invention is a step of mixing the lymphocyte derived from the subject, the inactivated cancer cell derived from the subject, and the T lymphocyte derived from the subject and culturing the mixture to produce a tumor specific T cell.

In a further embodiment, the step (A) in the present invention is a step of mixing the peptide determined in "Cancer idiotype peptide sensitization immune cell therapeutic method", the inactivated cancer cell derived from the subject, and the T lymphocyte derived from the subject and culturing the mixture to produce a tumor specific T cell.

Such therapy of an isolated tailor-made cancer specific T cell receptor gene and a cancer specific TCR gene can be used in patients with a wide range of cancer, including, but not limited to, adrenocortical carcinoma, anal cancer, bile duct cancer, bladder cancer, breast cancer, cervical cancer, chronic lymphocytic leukemia, chronic myelogenous leukemia, colorectal cancer, endometrial cancer, esophageal cancer, Ewing tumor, gallbladder cancer, Hodgkin's disease, hypopharyngeal cancer, laryngeal cancer, lip and oral cavity cancer, liver cancer, non-small-cell lung cancer, non-Hodgkin's lymphoma, melanoma, mesothelioma, multiple myeloma, ovarian cancer, pancreatic cancer, prostate cancer, gastric cancer, testicular cancer, thyroid cancer and the like.

In a further aspect, the present invention provides isolation of a tailor-made cancer specific T cell receptor gene, and isolation of a cancer specific TCR gene by searching for a common sequence. Thus, the present invention provides a method of preparing an isolated cancer specific TCR gene by searching for a common sequence, comprising: (A) providing a lymphocyte or cancer tissue isolated from subjects having a common HLA; (B) analyzing a TCR of the tumor specific T cell by the repertoire analysis method of the present invention or the repertoire analysis system of the present invention for the lymphocyte or cancer tissue; and (C) isolating a T cell having a sequence in common with the tumor specific T cell. Once genetic information is obtained, preparation of an isolated cancer specific TCR gene by searching for a common sequence can be performed by using any well-known technology in the art. A gene obtained by such isolation of tailor-made cancer specific T cell receptor gene or isolation of a cancer specific TCR gene by searching for a common sequence can be used in therapy and prevention of a variety of cancers. The method is also called "method of isolation of tailor-made cancer specific T cell receptor gene or isolation of cancer specific TCR gene by searching for a common sequence of the present invention".

A gene obtained by such isolation of a tailor-made cancer specific T cell receptor gene or isolation of a cancer specific TCR gene by searching for a common sequence can be implemented in clinical practice by using the following specific procedures. In one embodiment, it is possible to materialize therapy using a gene obtained by isolation of a tailor-made cancer specific T cell receptor gene or isolation of a cancer specific TCR gene by searching for a common sequence from the following: first (1) tumor cells are extracted or peripheral blood is separated from cancer patients with the same HLA; (2) repertoire analysis is performed by using a lymphocyte cell or tumor tissue comprising a tumor cell infiltrated T cell; (3) a ranking is produced for each sample based on a frequency of presence thereof, and a tumor specific T cell exhibiting a higher frequency of presence in a tumor cell relative to a peripheral blood cell is selected; (4) a common sequence in a plurality of HLA matching cancer patients is searched for the tumor specific T cell; (5) a tumor specific TCR gene shared by the most cancer patients is selected as a tumor specific TCR for therapy; (6) the full length TCRα and TCRβ genes are cloned and introduced into a retroviral vector for gene expression; (7) a gene introducing virus is created from the TCRα and TCRβ gene expression retroviral vector; (8) lymphocytes collected from the patient are infected independently and successively with TCRα and TCRβ for transfection, or a gene expression retroviral vector comprising both TCRα and TCRβ genes is created to transform both genes at once; (9) expression of TCRα/TCRβ heterodimers on a cell surface is confirmed; and (10) a tumor specific patient lymphocyte expressing TCRα/TCRβ of interest is introduced into the cells of the patient.

Therapy using a gene obtained by such isolation of a tailor-made cancer specific T cell receptor gene or isolation of a cancer specific TCR gene by searching for a common sequence can be used in patients with a wide range of cancer, for example including, but not limited to, adrenocortical carcinoma, anal cancer, bile duct cancer, bladder cancer, breast cancer, cervical cancer, chronic lymphocytic leukemia, chronic myelogenous leukemia, colorectal cancer, endometrial cancer, esophageal cancer, Ewing tumor, gallbladder cancer, Hodgkin's disease, hypopharyngeal cancer, laryngeal cancer, lip and oral cavity cancer, liver cancer, non-small-cell lung cancer, non-Hodgkin's lymphoma, melanoma, mesothelioma, multiple myeloma, ovarian cancer, pancreatic cancer, prostate cancer, gastric cancer, testicular cancer, thyroid cancer and the like.

Thus, in another aspect, the present invention provides a method of isolating a cancer specific TCR gene by an in vitro antigen stimulation, comprising: (A) mixing an antigen peptide or antigen protein derived from a subject or the peptide determined in a cancer idiotype peptide sensitization immune cell therapeutic method or a lymphocyte derived from the subject, an inactivated cancer cell derived from the subject, and a T lymphocyte derived from the subject and culturing the mixture to produce a tumor specific T cell; (B) analyzing a TCR of the tumor specific T cell by the repertoire analysis method of the present invention or the repertoire analysis system of the present invention; and (C) isolating a desired tumor specific T cell based on a result of the analyzing. Once genetic information is obtained, preparation of a cancer specific TCR gene isolated by such an in vitro antigen stimulation can be performed by using any well-known technology in the art. Such an isolated tailor-made cancer specific T cell receptor gene or cancer specific TCR gene can be used in therapy and prevention of a variety of cancers.

Thus, in one embodiment of the method of isolating a cancer specific TCR gene by an in vitro antigen stimulation, the step (A) in the present invention comprises a step of mixing the inactivated cancer cell derived from the subject and the antigen peptide or antigen protein derived from the subject with the T lymphocyte derived from the subject and culturing the mixture to produce a tumor specific T cell.

In a further embodiment, the step (A) in the present invention is a step of mixing the lymphocyte derived from the subject, the inactivated cancer cell derived from the subject, and the T lymphocyte derived from the subject and culturing the mixture to produce a tumor specific T cell.

In a further embodiment, the step (A) in the present invention is a step of mixing the peptide determined in "Cancer idiotype peptide sensitization immune cell therapeutic method", the inactivated cancer cell derived from the subject, and the T lymphocyte derived from the subject and culturing the mixture to produce a tumor specific T cell.

In still another aspect, the present invention provides a technique of isolating a cancer specific TCR gene by searching for a common sequence or isolating a tailor-made cancer specific T cell receptor gene, comprising: (A) isolating a lymphocyte or cancer tissue from subjects having a common HLA; (B) analyzing a TCR of the tumor specific T cell by the repertoire analysis method of the present invention for the lymphocyte or cancer tissue; and (C) isolating a T cell having a sequence in common with the tumor specific T cell. Such an isolated tailor-made cancer specific T cell receptor gene or cancer specific TCR gene can be used in therapy and prevention of a variety of cancers.

<Cell Processing Therapeutic Method>

In a further aspect, the present invention provides a cell processing therapeutic method. Specifically, the present invention provides a method of preparing a T lymphocyte introduced with a tumor specific TCR gene for use in cell processing therapeutic method, comprising: A) providing a T lymphocyte collected from a patient; B) analyzing TCRs based on the repertoire analysis method of the present invention or the repertoire analysis system of the present invention after applying an antigen stimulation to the T lymphocyte, wherein the antigen stimulation is applied by an antigen peptide or antigen protein derived from the subject, an inactivated cancer cell derived from the subject, or an idiotype peptide derived from tumor; C) selecting an optimal TCR and an optimal antigen in the analyzed TCRs; and D) producing a tumor specific α and β TCR expression viral vector of a TCR gene of the optimal TCR. The cell processing therapeutic method using the T lymphocyte introduced with a tumor specific TCR gene can be used for the therapy and prevention of a variety of cancers.

Such a cell processing therapeutic method using a T lymphocyte introduced with a tumor specific TCR gene can be implemented in clinical practice by using the following specific procedures. For example, a lymphocyte introduced with a tumor specific TCR gene can be used by the method described in <Isolation of tailor-made cancer specific T cell receptor gene, isolation of cancer specific TCR gene by in vitro antigen stimulation> or <Isolation of tailor-made cancer specific T cell receptor gene, isolation of cancer specific TCR gene by searching for a common sequence>.

Thus, any cancer antigen or cancer peptide can be manufactured or produced by synthesis as an antigen to utilize a collected inactivated patient cancer cell or to utilize an idiotype peptide derived from tumor in the cell processing therapeutic method of the present invention. As a selection method, it is possible to select an antigen highly expressed in cancer tissue or select a peptide that binds to the HLA type of a patient as an antigen.

In a preferred embodiment of the cell processing therapeutic method of the present invention, examples of conceivable optimal antigen that can be selected include, but are not limited to, (1) an antigen highly expressed in the patient's cancer tissue, (2) an antigen that most strongly activates a T cell in an antigen specific lymphocyte stimulation test, and (3) an antigen that increases the frequency of a specific TCR the most from repertoire analysis before and after an antigen stimulation. Further, it is also possible to conceive a method of selecting, as an optimal TCR, a TCR that has increased the most in an example (3), where the frequency of a specific TCR increased the most from repertoire analysis before and after an antigen stimulation. Further, it is possible to select, as the optimal TCR, a candidate optimal TCR which is artificially transgenically introduced into a lymphocyte of a patient and exhibits the highest reactivity in actual cancer tissue of the patient as a typical example.

Such a cell processing therapeutic method using a T lymphocyte introduced with a tumor specific TCR gene can be used in patients with a wide range of cancer including, but not limited to, for example adrenocortical carcinoma, anal cancer, bile duct cancer, bladder cancer, breast cancer, cervical cancer, chronic lymphocytic leukemia, chronic myelogenous leukemia, colorectal cancer, endometrial cancer, esophageal cancer, Ewing tumor, gallbladder cancer, Hodgkin's disease, hypopharyngeal cancer, laryngeal cancer, lip and oral cavity cancer, liver cancer, non-small-cell lung cancer, non-Hodgkin's lymphoma, melanoma, mesothelioma, multiple myeloma, ovarian cancer, pancreatic cancer, prostate cancer, gastric cancer, testicular cancer, thyroid cancer and the like.

Thus, in one embodiment, the antigen stimulation of the method of the present invention is applied with the antigen peptide or antigen protein derived from the subject.

In another embodiment, the antigen stimulation of the method of the present invention is applied with the inactivated cancer cell derived from the subject.

In another embodiment, the antigen stimulation of the method of the present invention is applied with the idiotype peptide derived from tumor.

In another embodiment, the step C) of the present invention comprises selecting an antigen that is highly expressed in cancer tissue of the subject.

In another embodiment, the step C) of the present invention comprises selecting an antigen which most strongly activates a T cell in an antigen specific lymphocyte stimulation test.

In another embodiment, the step C) of the present invention comprises selecting an antigen that increases a frequency of a specific TCR the most from repertoire analysis conducted based on the repertoire analysis method of the present invention or the repertoire analysis system of the present invention before and after applying the antigen stimulation.

In one specific embodiment, the present invention provides a method of assessing efficacy and/or safety by a stimulation test in vitro by using a cancer specific TCR gene isolated by <Isolation of tailor-made cancer specific T cell receptor gene, isolation of cancer specific TCR gene by searching for a common sequence the present invention>.

Efficacy can be assessed, for example, by culturing an antigen protein or antigen peptide derived from a subject who received an antigen stimulation with an antigen protein or antigen peptide derived from the subject and a T cell introduced with a cancer specific TCR gene, an inactivated cancer cell derived from the subject who has received an antigen stimulation with an inactivated cancer cell derived from the subject, and an idiotype peptide derived from tumor which has received an antigen stimulation with an idiotype peptide derived from tumor, and then measuring the amount of cytokines (interferon γ or the like) secreted out of a cell in response to T cell activation, measuring the amount of expression of a specific gene that is elevated in response to T cell activation, or measuring a cell surface molecule that is expressed or increases expression in response to T cell activation.

<Safety> When a T cell derived from the subject introduced with a cancer specific TCR gene is mixed with a normal cell derived from the subject, safety can be assessed, for example, by measuring secreted cytokines, gene expression, or expression of a cell surface molecule in response to activation of the above-described T and verifying that the TCR gene introduced T cell is not activated by a normal cell.

In one embodiment, the specific steps of efficacy and/or safety assessment can be materialized as follows. For example: (1) a retroviral gene expression system is used to create a tumor specific TCRα and TCRβ gene introduced T lymphocyte cell; (2) when assessing efficacy, a cancer cell derived from a patient is extracted, separated, and immortalized, and then subjected to mixing and culturing with a T lymphocyte introduced with a tumor specific TCR gene; (3) reactivity to a tumor cell can be quantitatively assessed to select a TCR gene reacting more strongly to a tumor cell by using the above-described culture cell and performing a cell proliferation test (thymidine uptake test, MTT test, IL-2 production test or the like); (4) when assessing safety, a control, which is an existing cell line, normal tissue free of patient's cancer cells (part of the normal tissue collected in the process of extracting tumor), or patient's peripheral blood cells in the case where solid tumor is used and immortalized, and then subjected to mixing and culturing with a T lymphocyte introduced with a tumor specific TCR gene; and (5) reactivity to a tumor cell can be quantitatively assessed to select a TCR gene that exhibits no reactivity to a normal cell by using the above-described culture cell and performing a cell proliferation test (thymidine uptake test, MTT test, IL-2 production test or the like).

Thus, in another aspect, the present invention provides a cell processing therapeutic method, comprising: A) collecting a T lymphocyte from a patient; B) analyzing TCRs based on the repertoire analysis method or the repertoire analysis system of the present invention after applying antigen stimulation to the T lymphocyte, wherein the antigen stimulation is applied by an antigen peptide or antigen protein derived from the subject, an inactivated cancer cell derived from the subject, or an idiotype peptide derived from tumor; C) selecting an optimal TCR and an optimal antigen in the analyzed TCRs; D) producing a tumor specific α and β TCR expression viral vector of a TCR gene of the optimal TCR; and E) introducing the T lymphocyte introduced with a tumor specific TCR gene into the patient.

A method of implementing the steps of introducing a resulting T lymphocyte introduced with a tumor specific TCR gene into the patient comprises the following: A) manufacturing a T lymphocyte introduced with the tumor specific TCR gene; B) confirming expression of tumor specific TCRα and TCRβ; and C) intravenously introducing the T lymphocyte introduced with a tumor specific TCR gene by intravenous drip.

Thus, in one embodiment, the antigen stimulation in the cell processing therapeutic method of the present invention is applied with the antigen peptide or antigen protein derived from the subject.

In another embodiment, the antigen stimulation in the cell processing therapeutic method of the present invention is applied with the inactivated cancer cell derived from the subject.

In another embodiment, the antigen stimulation in the cell processing therapeutic method of the present invention is applied with the idiotype peptide derived from tumor.

In another embodiment, the step C) in the cell processing therapeutic method of the present invention comprises selecting an antigen that is highly expressed in cancer tissue of the subject.

In another embodiment, the step C) in the cell processing therapeutic method of the present invention comprises selecting an antigen which most strongly activates a T cell in an antigen specific lymphocyte stimulation test.

In another embodiment, the step C) in the cell processing therapeutic method of the present invention comprises selecting an antigen that increases a frequency of a specific TCR the most from repertoire analysis conducted based on the repertoire analysis method of the present invention before and after applying the antigen stimulation.

<Isolation of Human Form Antibody Utilizing BCR Repertoire Analysis>

As one embodiment, the repertoire analysis method of the present invention can be used to perform BCR gene repertoire analysis to quickly obtain a human form antibody specific to a target antigen by the methods described below. (A) a method of immunizing a mouse with a target antigen protein or antigen peptide and separating a cell population (e.g., spleen, lymph node, or peripheral blood cells) comprising an antibody producing B cell from the mouse to analyze immunoglobulin heavy chain and light chain genes by the repertoire analysis method of the present invention (A1) the method of A, wherein the immunized mouse is a KM mouse capable of producing a complete human antibody while maintaining antibody diversity (A2) the method of A, wherein the immunized mouse is a humanized mouse created by transplanting a human stem cell into an NOG (NOD/Shi-scid, IL-2Rγnull) mouse exhibiting severe combined immunodeficiency made by mating an IL-2 receptor γ chain knockout mouse with a NOD/scid mouse (B) comparing immunoglobulin heavy chain and light chain genetic sequences obtained from samples derived from a control mouse and an immunized mouse or mice before and after antigen immunization and frequencies thereof (C) identifying immunoglobulin heavy chain and light chain genes that are strongly expressed or increase after immunization in the immunized mouse (D) a method of selecting immunoglobulin heavy chain and light chain genes selected from step C and inserting the genes to match one type of antibody expression vector or inserting the genes separately into two types of antibody expression vectors (E) introducing the immunoglobulin heavy chain and light chain gene expression vector made in step D into a eukaryotic cell such as CHO (Chinese Hamster Ovary) and culturing the cell (F) separating/purifying an antibody molecule produced or secreted by a genetically modified cell to inspect specificity to a target antibody protein or peptide.

The above-described steps A-F are methods of directly and quickly obtaining an antigen specific human form antibody without altering an antibody gene derived from an animal after obtainment thereof into a chimeric antibody or humanized antibody of a human antibody. The methods can be used in the development and manufacture of an antibody medicine consisting of a human form antibody.

For KM mice used in this embodiment, the following can be referred: Ishida I, Tomizuka K, Yoshida H, Tahara T, Takahashi N, Ohguma A, Tanaka S, Umehashi M, Maeda H, Nozaki C, Halk E, Lonberg N. Production of human monoclonal and polyclonal antibodies in TransChromo animals. Cloning Stem Cells. 2002; 4(1): 91-102. Review. For NOG mice, the following can be referred: Ito M, Hiramatsu H, Kobayashi K, Suzue K, Kawahata M, Hioki K, Ueyama Y, Koyanagi Y, Sugamura K, Tsuji K, Heike T, Nakahata T. NOD/SCID/gamma(c)(null) mouse: an excellent recipient mouse model for engraftment of human cells. Blood. 2002 Nov. 1; 100(9): 3175-82. For CHO cells/antibody production, the following can be referred: Jayapal K P, Wlaschin K F, Hu W-S, Yap M G S. Recombinant protein therapeutics from CHO cells-20 years and counting. Chem Eng Prog. 2007; 103: 40?47; Chusainow J, Yang Y S, Yeo J H, Toh P C, Asvadi P, Wong N S, Yap M G. A study of monoclonal antibody-producing CHO cell lines: what makes a stable high producer? Biotechnol Bioeng. 2009 Mar. 1; 102(4): 1182-96.

<Isolation of Human Form Antibody Utilizing BCR Repertoire Analysis>

As one embodiment, the BCR gene repertoire analysis method can be utilized to quickly obtain a human form antibody specific to a target antigen by the methods described below.

(A) a method of immunizing a mouse with a target antigen protein or an antigen peptide and separating a cell population (e.g., spleen, lymph node, or peripheral blood cells) comprising an antibody producing B cell from the mouse to analyze immunoglobulin heavy chain and light chain genes by a BCR repertoire analysis method (A1) the method of A, wherein the immunized mouse is a KM mouse capable of producing a complete human antibody while maintaining antibody diversity (A2) the method of A, wherein the immunized mouse is a humanized mouse created by transplanting a human stem cell into an NOG (NOD/Shi-scid, IL-2Rγnull) mouse exhibiting severe combined immunodeficiency made by mating an IL-2 receptor γ chain knockout mouse with an NOD/scid mouse (B) comparing immunoglobulin heavy chain and light chain genetic sequences obtained from samples derived from a control mouse and an immunized mouse or mice before and after antigen immunization and frequencies thereof (C) identifying immunoglobulin heavy chain and light chain genes that are strongly expressed or increase after immunization in the immunized mouse (D) a method of selecting immunoglobulin heavy chain and light chain genes selected from step C and inserting the genes to match one type of antibody expression vector or inserting the genes separately into two types of antibody expression vectors (E) introducing the immunoglobulin heavy chain and light chain gene expression vector made in step D into a eukaryotic cell such as CHO (Chinese Hamster Ovary) and culturing the cell (F) separating/purifying an antibody molecule produced or secreted by a genetically modified cell to inspect specificity to a target antibody protein or peptide.

The above-described steps A-F are methods of directly and quickly obtaining an antigen specific human form antibody without altering an antibody gene derived from an animal after obtainment thereof into a chimeric antibody or humanized antibody of a human antibody. The methods can be used in the development and manufacture of an antibody medicine consisting of a human form antibody.

Embodiments of such methods include the following. As one example thereof,

1. A KM mouse is immunized with a Myelin Oligodendrocyte Glycoprotein (MOG35-55, MOG), which is an antigen peptide of experimental autoimmune encephalomyelitis. The same quantity of 2 mg/mL MOG peptide and complete Freund's adjuvant are mixed to create an emulsion. The mouse is subcutaneously immunized with 200 μg of MOG and simultaneously immunized in the peritoneal cavity with 400 ng of pertussis toxin. A control mouse is immunized with PBS and complete Freund's adjuvant.

2. On day 2 after the first immunization, the mouse is immunized with 400 ng of pertussis toxin. After confirming an outbreak on day 10 after the immunization, the spleen is extracted from the mouse with an episode of encephalomyelitis.

3. The spleens of the outbreak mouse and control mouse are used to carry out next generation BCR repertoire analysis. Frequencies of appearance of individual BCR sequences are counted and ranked for immunoglobulin heavy chain and immunoglobulin light chains.

4. BCR sequences with a large increase in the frequency of appearance in the outbreak mouse relative to the control mouse are extracted and ranked. A combination of high ranking BCR sequences induced by the antibody administration is identified as a MOG specific antibody gene.

5. A full length human immunoglobulin sequence is cloned by PCR-cloning from a BCR gene amplicon amplified from the outbreak mouse. Each of the IgG immunoglobulin heavy chain and the immunoglobulin light chain is cloned in an antibody expression vector. There is a method of inserting the genes to match one type of antibody expression vector or inserting the genes separately into two types of antibody expression vectors.

6. A CHO (Chinese Hamster Ovary) cell is transformed by using Lipofectamine 3000 (Life Science) and IgG immunoglobulin heavy chain and immunoglobulin light chain are introduced with the constructed expression vector.

7. A CHO cell culture solution is collected. Secreted antibody proteins are collected by purification with a protein A affinity column and concentration with gel filtration.

8. binding activity to MOG35-55 or MOG protein is measured by an ELISA assay using the collected antibody to investigate the specificity of the antibody.

9. When sufficient specificity is obtained, a cell line stably expressing an antibody is acquired and a human form anti-MOG antibody is manufactured with a large-scale culturing system.

(Peptide and Therapy of the Present Invention)

The peptide of the present invention or a nucleic acid encoding the same can be used in immunotherapy. Description thereof is provided below.

A peptide provided by the present invention is derived from an antigen associated with tumorigenesis and can have the ability to bind sufficiently to an MHC (HLA) class II molecule to trigger an immune response in a human, especially a lymphocyte, especially a T lymphocyte, especially a CD4 positive T lymphocyte, and especially a TH1 type immune response induced by a CD4 positive T lymphocyte.

As used herein, "protein", "polypeptide", "oligopeptide" and "peptide" are used to have the same meaning and refer to an amino acid polymer of any length. Such a polymer may be a branched or straight chain or annular. An amino may be a natural or non-natural or altered amino acid. The term may also encompass those assembled into a complex of a plurality of polypeptide chains. The term also encompasses natural or artificially altered amino acid polymers. Examples of such an alteration include disulfide bond formation, glycosylation, lipidation, acetylation, phosphorylation or any other manipulation or alteration (e.g., conjugation with a labeling component). The definition also encompasses, for example, a polypeptide comprising one or more analogs of an amino acid (e.g., including a non-natural amino acid, etc.), peptide-like compound (e.g., peptoid), and other known alterations in the art. As used herein, "amino acid" may be natural or non-natural as long as the objective of the present invention is met.

As used herein, "polynucleotide", "oligonucleotide" and "nucleic acid" are used in the same meaning and refer to a nucleotide polymer with any length. The term also encompasses "oligonucleotide derivative" and "polynucleotide derivative". "Oligonucleotide derivative" or "polynucleotide derivative" refers to an oligonucleotide or a polynucleotide, which has a bond between nucleotides that is not normal or includes a derivative of a nucleotide. They are interchangeably used. Specific examples of such an oligonucleotide include 2'-O-methyl-ribonucleotide, oligonucleotide derivative with a phosphodiester bond in an oligonucleotide converted to a phosphorothioate bond, oligonucleotide derivative with a phosphodiester bond in an oligonucleotide converted to an N3'—P5' phosphoroamidate bond, oligonucleotide derivative with a ribose and phosphodiester bond in an oligonucleotide converted to a peptide nucleic acid bond, oligonucleotide derivative with uracil in an oligonucleotide substituted with C-5 propynyl uracil, oligonucleotide derivative with uracil in an oligonucleotide substituted with C-5 thiazole uracil, oligonucleotide derivative with cytosine in an oligonucleotide substituted with C-5 propynyl cytosine, oligonucleotide derivative with cytosine in an oligonucleotide substituted with phenoxazine-modified cytosine, oligonucleotide derivative with ribose in a DNA substituted with 2'-O-propylribose, oligonucleotide derivative with ribose in an oligonucleotide substituted with 2'-methoxyethoxyribose and the like. Unless specifically noted otherwise, a specific nucleic acid sequence is further intended to encompass conservatively altered variants (e.g., degenerate codon substituted form) and complementary sequences thereof in addition to the explicitly shown sequences. Specifically, a degenerate codon substituted form can be obtained by creating a sequence in which the third position of one or more selected (or all) codons is substituted with a mixed base and/or deoxyinosine residue (Batzer et al., Nucleic Acid Res. 19: 5081 (1991); Ohtsuka et al., J. Biol. Chem. 260: 2605-2608 (1985); Rossolini et al., Mol. Cell. Probes 8: 91-98 (1994)). As used herein, "nucleic acid" is interchangeably used with gene, cDNA, mRNA, oligonucleotide, and polynucleotide. As used herein, "nucleotide" may be natural or non-natural.

As used herein, "gene" refers to an agent defining a genotype. A "gene" may refer to a "polynucleotide", "oligonucleotide" or "nucleic acid".

In addition to the identified peptides, a variant thereof may also be used in the present invention. Examples of such a variant include, but are not limited to, those that are homologous to the identified peptide.

As used herein, "homology" of genes refers to the level of identity of 2 or more genetic sequences to one another. In general, having "homology" refers to having a high level of identity or similarity. Thus, a higher level of homology of two genes results in a higher level of identity or similarity of sequences thereof. It is possible to examine whether two types of genes are homologous by direct comparison of sequences or by hybridization under stringent conditions for nucleic acids. When directly comparing two genetic sequences, the genes are homologous typically when DNA sequences between the genetic sequences are at least 50% identical, preferably at least 70% identical, and more preferably at least 80%, 90%, 95%, 96%, 97%, 98% or 99% identical. Thus, as used herein, "homolog" or "homologous gene product" refers to a protein in another species, preferably a mammal, which exerts the same biological function as a protein constituent element of a complex further described herein. Such a homolog is also called "ortholog gene product". It is understood that such a homolog, homolog gene product, ortholog gene product and the like can also be used as long as they align with the objective of the present invention.

An amino acid may be mentioned herein by a commonly known three letter symbol thereof or a one letter symbol recommended by IUPAC-IUB Biochemical Nomenclature Commission. Similarly, a nucleotide may be mentioned by a commonly recognized one letter code. Herein, comparison of similarity, identity and homology of amino acid sequences and base sequences is calculated by using a default parameter with a sequence analysis tool BLAST. For instance, identity can be searched by using NCBI's BLAST 2.2.28 (published on 2013 Apr. 2). The value of identity herein generally refers to a value from using the above-described BLAST to align sequences under default conditions. However, when a higher value is output by changing a parameter, the highest value is considered the value of identity. When identity is assessed in a plurality of regions, the highest value thereamong is considered the value of identity. Similarity is a numerical value that uses a similar amino acid into the calculation in addition to identity.

In one embodiment of the present invention, "several" may be, for example, 10, 8, 6, 5, 4, 3 or 2, or a value less than any one of the value. It is known that a polypeptide with a deletion, addition, insertion or other amino acid substitutions of one to several amino acid residues maintains its biological activity (Mark et. al., Proc Natl Acad Sci USA. 1984 September; 81(18): 5662-5666., Zoller et al., Nucleic Acids Res. 1982 Oct. 25; 10(20): 6487-6500, Wang et al., Science. 1984 Jun. 29; 224 (4656): 1431-1433). An antibody with a deletion or the like can be made, for example, by site-directed mutagenesis, random mutagenesis, biopanning using an antibody phage library or the like. For example, KOD-Plus-Mutagenesis Kit (TOYOBO CO., LTD.) can be used for site-directed mutagenesis. An antibody with the same activity as the wild-type can be selected from mutant antibodies introduced with a deletion or the like by performing various characterizations such as FACS analysis or ELISA.

In one embodiment of the present invention, "90% or greater" may be, for example, 90, 95, 96, 97, 98, 99 or 100% or greater or within the range of any of the two values. For the above-described "homology", the percentage of the number of homologous amino acids in two or a plurality of amino acid sequences may be calculated in accordance with a known method in the art. Before calculating the percentage, amino acid sequences in a group of amino acid sequences to be compared are aligned. A space is introduced in a portion of amino acid sequences when necessary to maximize the percentage of the same amino acids. An alignment method, method of calculating the percentage, comparison method, and computer programs associated therewith have been well known in the art (e.g., BLAST, GENETYX and the like). As used herein, "homology" can represent a value measured by BLAST of NCBI unless specifically noted otherwise. Blastp can be used in the default setting for an algorithm for comparing amino acid sequences with BLAST. Results of measurement are expressed in a numerical form as Positives or Identities.

As used herein, "polynucleotide that hybridizes under stringent conditions" refers to a conventional, well-known condition in the art. Such a polynucleotide can be obtained by using colony hybridization, plaque hybridization, southern blot hybridization or the like while using a polynucleotide selected from the polynucleotides of the present invention as a probe. Specifically, such a polynucleotide refers to a polynucleotide which can be identified by using a filter with immobilized DNA derived from a colony or a plaque for hybridization at 65° C. in the presence of 0.7-1.0 M NaCl, and then using a 0.1 to 2-fold concentration SSC (saline-sodium citrate) solution (composition of an SSC solution with 1-fold concentration is 150 mM sodium chloride and 15 mM sodium citrate) to wash the filter under the condition of 65° C. For "stringent condition", the following are examples of conditions that can be used. (1) low ionic strength and a high temperature are used for washing (e.g., 0.015 M sodium chloride/0.0015 M sodium citrate/0.1% sodium dodecyl sulfate at 50° C.), (2) a denaturing agent such as formamide is used in hybridization (e.g., 50% (v/v) formamide, 0.1% bovine serum albumin/0.1% ficoll/0.1% polyvinyl pyrrolidone/50 mM sodium phosphate buffer with a pH of 6.5, 750 mM sodium chloride, and 75 mM sodium citrate at 42° C.), or (3) a solution comprising 20% formamide, 5×SSC, 50 mM sodium phosphate (pH 7.6), 5×Denhardt's solution, 10% dextran sulfate, and 20 mg/ml denatured sheared salmon sperm DNA, is incubated overnight at 37° C. and then a filter is washed with 1×SSC at about 37-50° C. The formamide concentration may be 50% or greater. Washing time may be 5, 15, 30, 60, 120 minutes, or greater. A plurality of elements are considered to affect stringency in a hybridization reaction such as temperature, salt concentration and the like. Ausubel et al., Current Protocols in Molecular Biology, Wiley Interscience Publishers, (1995) can be referred for details. "Highly stringent condition", for example, is 0.0015 M sodium chloride, 0.0015 M sodium citrate, and 65-68° C. or 0.015 M sodium chloride, 0.0015 M sodium citrate, 50% formamide and 42° C. Hybridization is performed in accordance with the method described in experimental publications such as Molecular Cloning 2$^{nd}$ ed., Current Protocols in Molecular Biology, Supplement 1-38, DNA Cloning 1: Core Techniques, A Practical Approach, Second Edition, Oxford University Press (1995). In this regard, a sequence comprising only an A sequence or only a T sequence is preferably excluded from a sequence that hybridizes under stringent conditions. A moderately stringent condition can be readily determined by those skilled in the art based on, for example, the length of a DNA and is shown in Sambrook et al., Molecular Cloning: A Laboratory Manual, Third Ed., Vol. 1, 7.42-7.45 Cold Spring Harbor Laboratory Press, 2001, including, for a nitrocellulose filters, hybridization conditions of a pre-wash solution of 1.0 mM EDTA (pH 8.0), 5×SSC, 0.5% SDS, and about 50% formamide and 2×SSC-6×SSC at about 40-50° C. (or other similar hybridization solutions such as a Stark's solution in about 50% formamide at about 42° C.) and washing conditions of 0.5×SSC, 0.1% SDS at about 60° C. Thus, the polypeptides used in the present invention encompass polypeptides encoded by a nucleic acid molecule that hybridizes under highly or moderately stringent conditions to a nucleic acid molecule encoding a polypeptide particularly described in the present invention.

As used herein, "purified" substance or biological agent (e.g., nucleic acid, protein or the like) refers to a substance or biological agent having at least some of the agents that are naturally accompanied therewith removed. Thus, purity of a biological agent in a purified biological agent is higher than that of a normal condition of the biological agent (i.e., concentrated). The term "purified" as used herein preferably refers to the presence of at least 75 wt. %, more preferably at least 85 wt. %, still more preferably at least 95 wt. %, and the most preferably at least 98 wt. % of biological agents of the same type. A substance or biological agent used in the present invention is preferably a "purified" substance. An "isolated" substance or biological agent (e.g., nucleic acid, protein, or the like) as used herein refers to a substance or biological agent having agents that are naturally accompanied therewith substantially removed. The term "isolated" as used herein varies depending on the objective. Thus, the term does not necessarily need to be represented by purity. However, when necessarily, the term refers to preferably the presence of at least 75 wt. %, more preferably at least 85 wt. %, still more preferably at least wt. % and the most preferably at least 98 wt. % of biological agents of the same type. A substance used in the present invention is preferably an "isolated" substance or biological agent.

As used herein, "fragment" refers to a polypeptide or polynucleotide with a sequence length of 1 to n−1 with respect to the full length polypeptide or polynucleotide (with length n). The length of a fragment can be appropriately changed in accordance with the objective. Examples of the lower limit of such a length include 3, 4, 5, 6, 7, 8, 9, 10, 15, 20, 25, 30, 40, 50 and more amino acids for a polypeptide. Lengths represented by an integer that is not specifically listed herein (e.g., 11 and the like) also can be suitable as a lower limit. Further, examples of length include 5, 6, 7, 8, 9, 10, 15, 20, 25, 30, 40, 50, 75, 100, and more nucleotides for a polynucleotide. Lengths represented by an integer that is not specifically listed herein (e.g., 11 and the like) also can be suitable as a lower limit. As used herein, such a fragment is understood to be within the scope of the present invention, for example, when a full length version functions as a marker or a target molecule, as along as the fragment itself also functions as a marker or a target molecule.

As used herein, "functional equivalent" refers to any entity having the same function of interest but a different structure relative to the original target entity. A functional equivalent can be found by searching a database or the like. As used herein, "search" refers to utilizing a certain nucleic acid base sequence electronically, biologically, or by another method to find another nucleic acid base sequence having a specific function and/or property. Examples of electronic search include, but are not limited to, BLAST (Altschul et al., J. Mol. Biol. 215:403-410 (1990)), FASTA (Pearson & Lipman, Proc. Natl. Acad. Sci., USA 85: 2444-2448 (1988)), Smith and Waterman method (Smith and Waterman, J. Mol. Biol. 147: 195-197 (1981)), Needleman and Wunsch method (Needleman and Wunsch, J. Mol. Biol. 48: 443-453 (1970)) and the like. Examples of biological search include, but are not limited to, stringent hybridization, a macroarray with a genomic DNA applied to a nylon membrane or the like or a microarray with a genomic DNA applied to a glass plate (microarray assay), PCR, in situ hybridization and the like. Herein, a gene used in the present invention is intended to include corresponding genes identified by such electronic search or biological search.

As a functional equivalent of the present invention, it is possible to use an amino acid sequence with one or more amino acid insertions, substitutions or deletions, or addition to one or both ends. As used herein, "one or more amino acid insertions, substitutions or deletions, or addition to one or both ends" in an amino acid sequence refers to an alteration with a substitution of a plurality of amino acids or the like to the extent that can occur naturally by a well-known technical method such as site-directed mutagenesis or natural mutation. An altered amino acid sequence of a molecule can have, for example, 1-30, preferably 1-20, more preferably 1-9, still more preferably 1-5, and especially preferably 1-2 amino acid insertion, substitution or deletion or addition to one or both ends. An altered amino acid sequence may be an amino acid sequence having one or more (preferably 1 or several, or 1, 2, 3 or 4) conservative substitutions in an amino acid sequence such as CCL21, CXCR3, or CCR7. "Conservative substitution" refers herein to a substitution of one or more amino acid residues with another chemically similar amino acid residue so as not to substantially alter a function of a protein. Examples thereof include cases where a hydrophobic residue is substituted with another hydrophobic residue, cases where a polar residue is substituted with another polar residue having the same charge and the like. Functionally similar amino acids that can be substituted in this manner are known in the art for each amino acid. Specific examples include alanine, valine, isoleucine, leucine, proline, tryptophan, phenylalanine, methionine and the like for nonpolar (hydrophobic) amino acids, glycine, serine, threonine, tyrosine, glutamine, asparagine, cysteine and the like for polar (neutral) amino acids. Examples of positively charged (basic) amino acid include arginine, histidine, lysine and the like. Further, examples of a negatively-charged (acidic) amino acid include aspartic acid, glutamic acid and the like.

As used herein, "subject" refers to a target subjected to diagnosis, detection or the like of the present invention.

As used herein, "agent" is used broadly and may be any substance or other elements (e.g., energy, radiation, heat, electricity and other forms of energy) as long as the intended objective can be achieved. Examples of such a substance include, but are not limited to, protein, polypeptide, oligopeptide, peptide, polynucleotide, oligonucleotide, nucleotide, nucleic acid (including for example DNAs such as cDNA and genomic DNA, RNAs such as mRNA), polysaccharide, oligosaccharide, lipid, organic small molecule (e.g., hormone, ligand, information transmitting substance, organic small molecule, molecule synthesized by combinatorial chemistry, small molecule that can be used as medicine (e.g., small molecule ligand and the like) and a composite molecule thereof). Typical examples of an agent specific to a polynucleotide include, but are not limited to, a polynucleotide having complementarity with a certain sequence homology (e.g., 70% or greater sequence identity) to a sequence of the polynucleotide, polypeptide such as a transcription factor that binds to a promoter region and the like. Typical examples of an agent specific to a polypeptide include, but are not limited to, an antibody directed specifically to the polypeptide or a derivative or analog thereof (e.g., single strand antibody), a specific ligand or receptor when the polypeptide is a receptor or ligand, a substrate when the polypeptide is an enzyme and the like.

As used herein, "therapy" refers to the prevention of amelioration, preferably maintaining the current condition, more preferably alleviation, and still more preferably disappearance of a disease or disorder (e.g., cerebral malaria) in case of such a condition, including being able to exert a prophylactic effect or an effect of improving one or more symptoms accompanying the disease. Preliminary diagnosis with suitable therapy may be referred to as "companion therapy" and a diagnostic agent therefor as "companion diagnostic agent".

As used herein, "therapeutic agent" broadly refers to all agents capable of treating a condition of interest (e.g., diseases such as cerebral malaria or the like) and refers to an inhibitor (e.g., antibody) such as those provided by the present invention. In one embodiment of the present invention, "therapeutic agent" may be a pharmaceutical composition comprising an effective ingredient and one or more pharmacologically acceptable carriers. A pharmaceutical composition can be manufactured, for example, by mixing an effective ingredient and the above-described carriers by any method known in the technical field of pharmaceuticals. Further, usage form of a therapeutic agent is not limited as long as it is used for therapy. A therapeutic agent may be an effective ingredient alone or a mixture of an effective ingredient and any ingredient. Further, the shape of the above-described carriers is not particularly limited. For example, the carrier may be a solid or liquid (e.g., buffer solution).

As used herein, "prevention" refers to the action of taking a measure against a disease or disorder (e.g., cerebral malaria) from being in such a condition prior to being in such a condition. For example, it is possible to use the agent of the present invention to perform diagnosis, and optionally use the agent of the present invention to prevent or take measures to prevent cerebral malaria or the like.

As used herein, "prophylactic agent" broadly refers to all agents capable of preventing a condition of interest (e.g., diseases such as cerebral malaria or the like).

The present invention provides a peptide derived from an antigen associated with tumorigenesis and have the ability to bind sufficiently to an MHC (HLA) class I molecule to trigger an immune response of a human leukocyte, especially a lymphocyte, especially a T lymphocyte, and especially a CD8 positive cytotoxic T lymphocyte, as well as combinations of two peptides especially useful for a vaccination of a cancer patient.

The peptide of the present invention may be derived from a tumor associated antigen, especially, for example, tumor associated antigens with a function in proteolysis, angiogenesis, cell growth, cell cycle regulation, cell division, transcriptional regulation, tissue infiltration or the like.

A peptide can be chemically synthesized and is usable as an effective pharmaceutical ingredient in manufacture of medicine. Thus, the peptide provided by the present invention can be used in immunotherapy or preferably cancer immunotherapy.

The pharmaceutical composition of the present invention further comprises an additional peptide and/or an excipient to increase the effect. This is further explained below.

The pharmaceutical composition of the present invention can comprise a peptide identified in the present invention, the peptide having a full length of 8-100 amino acids, preferably 8-30 amino acids, and most preferably 8-16 amino acids.

In addition, the peptide or variant can be further modified to improve the stability and/or binding to an MHC molecule in order to induce a more potent immune response. Methods of optimizing such a peptide sequence are well known to those skilled in the art, including, for example, introduction of a non-peptide bond or reversed peptide bond. Thus, another embodiment of the present invention provides a pharmaceutical composition wherein at least one peptide or a variant thereof comprises a non-peptide bond.

An amino acid residue in a reversed peptide bond is not bound by a peptide (—CO—NH—) where the peptide bond is reversed. Such a retro-inverso peptidomimetic can be made by using a method well known to those skilled in the art. Examples thereof include the method described in Meziere et al (1997) J. Immunol. 159, 3230-3237 incorporated herein as a reference. This approach involves creating a pseudo peptide comprising a change involving the backbone but not involving orientation of a side chain. Meziere et al (1997) show that such pseudo peptides are useful in an MHC and T helper cell response. A retro-inverso peptide comprising an NH—CO bond instead of a CO—NH peptide bond has much stronger resistance to proteolysis.

A non peptide bond is, for example, —CH$_2$—NH, —CH$_2$S—, —CH$_2$CH$_2$—, —CH═CH—, —COCH$_2$—, —CH(OH)CH$_2$—, or —CH$_2$SO—. U.S. Pat. No. 4,897,445 provides a method of solid phase synthesis of a non-peptide bond (—CH$_2$—NH) in a polypeptide chain, which involves a non-peptide bond synthesized by reacting amino aldehyde and amino acid in the presence of NaCNBH$_3$, and polypeptide synthesized by a standard procedure.

A peptide having a sequence of the present invention can be synthesized with an additional chemical group at the amino end and/or carboxy end thereof in order to strengthen, for example, the stability, bioavailability and/or affinity of the peptide. For example, it is possible to add a hydrophobic group such as a t-butyloxylcarbonyl group, dansyl group, or carbobenzoxy group at the amino end of the peptide. Similarly, an acetyl group or 9-fluorenylmethoxy-carbonyl group can be placed at the amino end of the peptide. In addition, it is possible to add, for example, the hydrophobic group, i.e., t-butyloxylcarbonyl group or amino group to the carboxy end of the peptide.

Furthermore, the peptide used in the present invention can be synthesized to change the steric configuration thereof. For example, a D-isomer of one or more amino acid residues of the peptide can be used instead of a common L-isomer. Furthermore, at least one amino acid residue of the peptide of the present invention can be substituted with a well-known non-natural amino acid residue. Such alteration can act to increase stability, bioavailability and/or binding action of the peptide of the present invention.

Similarly, the peptide or a variant of the present invention can be chemically modified by a reaction with a specific amino acid before or after synthesis of the peptide used in the present invention. Examples of such modification are well known in the art. Examples thereof are summarized in R. Lundblad, Chemical Reagents for Protein Modification, 3$^{rd}$ ed. CRC Press, 2005 incorporated herein by reference. Examples of chemical modification of an amino acid include, but are not limited to, modifications by acylation, amidination, pyridoxylation of lysine, reductive alkylation, trinitrobenzylation of an amino group by 2,4,6-trinitrobenzenesulfonic acid (TNBS), sulfhydryl modification by performic acid and amide modification of a carboxyl group, oxidation from cysteine to cystic acid, generation of mercury derivatives, generation of mixed disulfide with another thiol compound, reaction with maleimide, carboxymethylation with iodoacetic acid or iodoacetamide, and carbamoylation with cyanate at an alkaline pH. With regard to the above, those skilled in the art can reference a broader methodology related to chemical modification of a protein with Current Protocols In Protein Science, Eds. Coligan et al. (John Wiley & Sons NY 1995-2000). For example, modification of an arginine residue of a protein is often the formation of an additive based on a reaction of adjacent dicarbonyl compounds such as 1,2-cyclohexanedione, 2,3-butanedione, and phenylglyoxal. Another example is a reaction of an arginine residue with methylglyoxal. Cysteine can be modified without simultaneous modification of another nucleophilic site such as lysine or histidine. For this reason, numerous reagents can be utilized in cysteine modification. Information on specific reagents is provided by Pierce Chemical Company, Sigma-Aldrich, and other websites.

A disulfide bond in a protein used in the present invention is often selectively reduced. A disulfide bond can be formed and oxidized during heat treatment of a biomedicine. A specific glutamic acid residue can be modified by using Woodward's Reagent K. An intermolecular crosslink can be formed between a lysine residue and a glutamic acid residue by using N-(3-(dimethylamino)propyl)-N'-ethylcarbodiimide. For example, diethylpyrocarbonate is a reagent for modifying a histidine residue in a protein. Histidine can also be modified by using 4-hydroxy-2-nonenal. A reaction between a lysine residue and another α amino acid group is useful, for example, in a bond between a peptide and a surface or protein/peptide crosslink. Lysine is a site where poly(ethylene)glycol attaches and is a main site of modification in glycation of a protein. A methionine residue of a protein can be modified, for example, by iodoacetamide, bromoethylamine, or chloramine-T. Tetranitromethane and N-acetylimidazole can be used in modification of a tyrosyl residue. A crosslink by formation of dityrosine can be accomplished with hydrogen peroxide/copper ions. N-bromosuccinimide, 2-hydroxy-5-nitrobenzyl bromide and 3-bromo-3-methyl-2-(2-nitrophenyl mercapto)-3H-indole (BPNS-skatole) were used in a recent study related to tryptophan modification. Suitable modification of a therapeutic protein and peptide with PEG often involves prolonging the circulation half-life. In addition, protein crosslink by glutaraldehyde, polyethylene glycol diacrylate and formaldehyde is used for preparation of a hydrogel. Chemical modification of an allergen for immunotherapy is often accomplished by carbamylation with potassium cyanate.

In general, the peptides and variants used in the present invention (at least those comprising a peptide link between amino acid residues) can be synthesized, for example, by using a Fmoc-polyamide form of solid phase peptide synthesis, as disclosed in Lu et al (1981) J. Org. Chem. 46, 3433 and a reference thereof. Purification can be performed by a combination of one or more technologies such as recrystallization, size exclusion chromatography, ion exchange chromatography, hydrophobic interaction chromatography, and reversed phase high-performance liquid chromatography that (generally) uses, for example, acetonitrile/water gradient separation. A peptide can be analyzed by using thin-layer chromatography, electrophoresis, especially caterpillar electrophoresis, solid phase extraction (CSPE), reversed phase high performance liquid chromatography, amino acid analysis after acid hydrolysis, fast atom bombardment (FAB) mass spectrometry, MALDI and ESI-Q-TOF mass spectrometry.

In still another aspect of the present invention, a nucleic acid (e.g., polynucleotide) encoding the peptide of the present invention or a variant thereof is provided. For example, DNA, cDNA, PNA, CNA, RNA, single strand and/or double strand, or natural or stable form of a polynucleotide such as a polynucleotide having phosphorothioate backbone or a combination thereof can be such a polynucleotide. It is not essential to contain intron as long as a polynucleotide encodes the peptide. Naturally, only peptides comprising a naturally occurring amino acid residue bound by a naturally occurring peptide bond is encoded by a polynucleotide. In yet another embodiment of the present invention, an expression vector with an ability to express the polypeptide according to the present invention is provided. Expression vectors of different cell types are well known in the art and can be selected without any special experimentation.

In general, a DNA is inserted into an expression vector such as a plasmid in a correct orientation with a correction reading frame for expression. If necessary, a DNA can be linked to a suitable transcription/translation regulating/managing nucleotide sequence which is recognized by a desired host. However, such a management function is generally in an expression vector. The vector is then introduced into a host by a standard technology. In regards to this, Sambrook et al (1989) Molecular Cloning, A Laboratory Manual, Cold Spring Harbor Laboratory, Cold Spring Harbor, N.Y. can be referred.

A regimen with the optimal dose and optimal amount of the nucleic peptide contained in a vaccine can be determined by those skilled in the art without any special experimentation. For example, the peptide or a mutant form thereof can be prepared as an intravenous (i.v.) injection, subcutaneous (s.c.) injection, intradermal (i.d.) injection, intraperitoneal (i.p.) injection, or intramuscular (i.m.) injection. Preferred routes of administration for a peptide injection are s.c., i.d., i.p., i.m., and i.v. Preferred routes of administration for a DNA injection are i.d., i.m., s.c., i.p., and i.v. For example, 1-500 mg, 50 µg-1.5 mg, preferably 125 µg-500 µg of peptide or DNA can be administered. The dose is dependent on each peptide or DNA. The dose in this range has been successfully used in clinical trials (Brunsvig P F, Aamdal S, Gjertsen M K, Kvalheim G, Markowski-Grimsrud C J, Sve I, Dyrhaug M, Trachsel S, Muller M, Eriksen J A, Gaudernack G; Telomerase peptide vaccination: a phase I/II study in patients with non-small cell lung cancer; Cancer Immunol Immunother. 2006; 55(12): 1553-1564; M. Staehler, A. Stenzl, P. Y. Dietrich, T. Eisen, A. Haferkamp, J. Beck, A. Mayer, S. Walter, H. Singh, J. Frisch, C. G. Stief; An open label study to evaluate the safety and immunogenicity of the peptide based cancer vaccine IMA901, ASCO meeting 2007; Abstract No 3017).

The selection, number, and/or amount of peptides in the pharmaceutical composition of the present invention can be made specific to tissue, cancer and/or patient in preparing the composition. For example, a side effect can be avoided by deriving a correction selection of peptide by the expression pattern of a protein of tissue of a given patient. The selection may be dependent on the cancer type and condition of the disease specific to a patient receiving therapy, therapeutic regimen up to this point, immune status of the patient and naturally, the HLA haplotype of the patient. Furthermore, the vaccine according to the present invention can comprise an individualized constituent element depending on individual needs of a specific patient. Examples thereof include expression of related TAA, personal side effects due to allergy or other therapy of the individual, and different amounts of peptide in accordance with adjustments for secondary therapy after a series of initial therapeutic plans for a specific patient.

A peptide in which a parent protein is highly expressed in normal tissue is avoided or is present at a low amount in the composition of the present invention. Meanwhile, when the tumor of a patient is known to highly express a specific protein, each pharmaceutical composition for the treatment of the cancer can be present at a high amount and/or comprise a plurality of peptides specific to the specific protein or route. Those skilled in the art can select a preferred combination of immunogenic peptides by testing T cell functionality, expansion, affinity and proliferation of a specific T cell against a specific peptide, overall presentation, in vitro T cell formation and efficacy thereof by, for example, analysis of IFN-γ (also see the following examples). Generally, the most efficient peptides are then combined as a vaccine for the aforementioned objective.

A suitable vaccine preferably contains 1-20 peptides, more preferably 2, 3, 4, 5, 6, 7, 8, 9, 10, 11, 12, 13, 14, 15, 16, 17, 18, 19 or 20 different peptides, still more preferably 6, 7, 8, 9, 10, 11, 12, 13 or 14 different peptides, and most preferably 14 different peptides. The length of the peptide used as a cancer vaccine may be any suitable peptides. Specifically, the length can be a suitable 9-mer peptide or a suitable 7-mer or 8-mer or 10-mer or 11-mer peptide or a 12-mer, 13-mer, 14-mer, or 15-mer peptide. A longer peptide is also suitable in some cases. As described in the appended Tables 1 and 2, a 9-mer or 10-mer peptide is preferred for an MHC class I peptide and a 12- to 15-mer is preferred for an MHC class II peptide.

The peptide of the present invention constitutes a tumor or cancer vaccine. The tumor or cancer vaccine can be administered directly to the organ with the disease or systemically into a patient, administered to the patient with a vaccine applied in vitro to a human cell line or a cell from the patient, or used in vitro to select a subpopulation from immune cells of a patient and readministered into the patient.

The peptide can be substantially pure, combined with an immunostimulatory adjuvant (see below), used in combination with an immunostimulatory cytokine, or coadministered with a suitable delivery system (e.g., liposome). The peptide can also be conjugated with a suitable carrier such as keyhole limpet hemocyanin (KLH) or mannan (see WO 95/18145 and Longenecker et al (1993) Ann. NY Acad. Sci.

690, 276-291). The peptide can also be tagged, or formed into a fusion protein or a hybrid molecule. A peptide given the sequence in the present invention is expected to stimulate CD4 or CD8CTL. However, efficiency of stimulation is increased more by a positive T cell providing assistance to the opposite CD. Thus, for an MHC class II epitope stimulating CD4CTL, a section of a hybrid molecule or a fusion partner thereof suitably provides an epitope stimulating a CD8 positive T cell. Meanwhile, for an MHC class I epitope stimulating CD8CTL, a section of a hybrid molecule or a fusion partner thereof suitably provides an epitope stimulating a CD4 positive T cell. CD4 and CD8 stimulating epitopes are well known in the art, including those specified in the present invention.

To elicit an immune response, it is generally necessary to include an excipient for enhancing immunogenicity of the composition. Thus, a pharmaceutical composition of a preferred embodiment of the present invention further has at least one suitable adjuvant. Since an adjuvant used in the present invention is a substance that non-specifically enhances or promotes an immune response to an antigen (e.g., immune response mediated by CTL and helper T (TH) cell), the adjuvant is understood to be useful for the agent of the present invention. Suitable adjuvants are, but not limited to, 1018 ISS, aluminum salt, Amplivac, AS15, BCG, CP-870, 893, CpG7909, CyaA, dSLIM, GM-CSF, IC30, IC31, imiquimod, ImuFact IMP321, IS Patch, ISS, ISCOMATRIX, JuvImmune, LipoVac, MF59, monophosphoryl lipid A, Montanide IMS 1312, Montanide ISA 206, Montanide ISA 50V, Montanide ISA-51, OK-432, OM-174, OM-197-MP-EC, ONTAK, PepTel® vector system, PLG microparticles, resiquimod, SRL172, virosome and other virus-like particles, YF-17D, VEGF trap, R848, β glucan, Pam3Cys, Aquila'S QS21 Stimulon (Aquila Biotech, Worcester, Mass., USA) (saponin derived substance), mycobacteria extract, and synthetic bacterial cell wall mimetics, and other exclusive adjuvants (Ribi's Detox, Quil, Superfos or the like). Adjuvants such as Freund's incomplete or GM-CSF are preferred. Several immunogenic adjuvants specific to dendritic cells (e.g., MF59) and formulations thereof have already been described (Dupuis M, Murphy T J, Higgins D, Ugozzoli M, van Nest G, Ott G, McDonald D M; Dendritic cells internalize vaccine adjuvant after intramuscular injection; Cell Immunol. 1998; 186(1): 18-27; Allison A C; The mode of action of immunological adjuvants; Dev Biol Stand. 1998; 92: 3-11). Further, cytokines can also be used. Some cytokines are directly linked to an effect on migration of dendritic cells to lymphocyte tissue (e.g., TNF-α) as accelerating the process of a dendritic cell maturing into an effective antigen-presenting cell against a T lymphocyte (e.g. GM-CSF, IL-1, IL-4) (U.S. Pat. No. 5,849,589 (the entirety thereof is incorporated by reference)), or as acting as an immunoadjuvant (e.g., IL-12) (Gabrilovich D I, Cunningham H T, Carbone D P; IL-12 and mutant P53 peptide-pulsed dendritic cells for the specific immunotherapy of cancer; J Immunother Emphasis Tumor Immunol. 1996 (6): 414-418).

It is reported that a CpG immunostimulatory oligonucleotide also enhances the effect of an adjuvant in a vaccine setting. Although not wishing to be bound by any theory, a CpG oligonucleotide has the action of activating an inherent (non-adaptive) immune system via a toll-like receptor (TLR) (mainly TLR9). TLR9 activity triggered by CpG enhances a humoral and cellular antigen specific response to various antigens including a peptide or protein antigen, live or killed virus, dendritic cell vaccine, autologous cell vaccine, and polysaccharide conjugate in both a prophylactic vaccine and therapeutic vaccine. More significantly, this increases maturation and differentiation of a dendritic cell and increases generation of cytotoxic T lymphocytes (CTL) and TH1 cell activity without assistance of a CD4 T cell. TH1 bias induced by a TLR9 stimulation is maintained, even in the presence of a vaccine adjuvant such as alum or Freund's incomplete adjuvant (IFA) that generally promotes TH2 bias. A CpG oligonucleotide is coformulated or coadministered with another adjuvant or is formed into a microparticle, nanoparticle, lipid emulsion or a similar formulation to exhibit a higher adjuvant activity. A CpG oligonucleotide is especially required for inducing a strong response in case of a relatively weak antigen. They also accelerate an immune response. In some experiments, an antibody response comparable with a full dose vaccine without CpG was obtained with an antigen dose that has been reduced by about double digits (Arthur M. Krieg, Therapeutic potential of Toll-like receptor 9 activation, Nature Reviews, Drug Discovery, 2006, 5, 471-484). U.S. Pat. No. 6,406,705 B1 describes that an antigen-specific immune response is elicited by a combination of a CpG oligonucleotide, non-nucleic acid adjuvant, and an antigen. Other TLR bound molecules such as RNA bound TLR7, TLR8, and/or TLR9 can also be used.

Examples of other useful adjuvants in the present invention include, but are not limited to, chemically modified CpGs (e.g., CpR, Idera), poly (I:C) (e.g., polyI: C12U), non-CpG bacterial DNA or RNA, imidazoquinoline, cyclophosphamide, sunitinib, bevacizumab, Celebrex, NCX-4016, sildenafil, tadalafil, vardenafil, sorafenib, XL-999, CP-547632, pazopanib, ZD2171, AZD2171, ipilimumab, tremelimumab, and SC58175, which can act as a therapeutic agent and/or adjuvant. In the context of the present invention, the amount and concentration of a useful adjuvant and additive can be readily determined by those skilled in the art without any special experimentation. Preferred adjuvants are dSLIM, BCG, OK432, imiquimod, PeviTer, and JuvImmune. In a preferred embodiment of the pharmaceutical composition of the present invention, the adjuvant is selected from the group comprising colony stimulating factors such as granulocyte macrophage colony stimulating factors (GM-CSF, sargramostim). In a preferred embodiment of the pharmaceutical composition of the present invention, the adjuvant is imiquimod.

The composition of the present invention is used in parenteral administration such as subcutaneous, intradermal, or intramuscular administration or oral administration. For this reason, the peptide and other selective molecules are dissolved or suspended in a pharmaceutically acceptable, preferably water-soluble carrier. In addition, the composition can comprise an excipient such as buffer, binding agent, blasting agent, diluent, flavoring agent, or lubricant. Further, the peptide can be co-administered with an immunostimulatory substance such as a cytokine. An extensive list of excipients that can be used in such a composition can be obtained from, for example, A. Kibbe, Handbook of Pharmaceutical Excipients, 3. Ed. 2000, American Pharmaceutical Association and pharmaceutical press. The composition can be used in tumor or cancer, preferably in CRC prevention and/or therapeutic method.

A cytotoxic T cell (CTL) recognizes a peptide shaped antigen bound to an MHC molecule, but not an original exogenous antigen itself. The MHC molecule itself is on a cell surface of an antigen-presenting cell. Thus, CTL activation is only possible in the presence of APC, MHC molecule, and trimer complex of a peptide antigen. Thus, CTL is not activated by using only a peptide. An immune response is increased by further adding APC with each MHC molecule. Thus, in a preferred embodiment, the pharmaceutical composition of the present invention additionally comprises at least one antigen-presenting cell.

An antigen-presenting cell (or a stimulator cell) generally has an MHC class I or II molecule on the surface thereof. In one embodiment, the MHC class I or II molecule having the selected antigen substantially cannot be loaded onto itself. As discussed below in detail, the selected antigen thereof can be readily loaded onto the MHC class I or II molecule in vitro.

In general, the pharmaceutical composition of the present invention comprising the nucleic acid of the present invention can be administered by the same method as a pharmaceutical composition comprising the peptide of the present invention, i.e., by intravenous, intraarterial, peritoneal, intramuscular, intradermal, intratumoral, oral, transdermal, transnasal cavity, trans-oral cavity, transrectal, or transvaginal administration, inhalation or topical administration.

Tumor often acquires resistance to a therapeutic agent by the mechanism of avoidance. The drug resistance occurs during therapy and in some cases appears as metastatic or recurrent tumor. To avoid such drug resistance, tumor therapy is generally administered by a combination of drugs. In many cases, a different combination is required for metastasis and tumor recurrence after an event-free period. Thus, in one embodiment of the present invention, the pharmaceutical composition is administered with a second anticancer agent. A second agent used in the present invention can be administered before, after or simultaneously with the pharmaceutical composition of the present invention. For example, if chemical properties are compatible, simultaneous administration can be performed by mixing the pharmaceutical composition of the present invention with the second anticancer agent. Another method of simultaneous administration is, for example, to inject the pharmaceutical composition of the present invention and orally administer a second anticancer agent to administer the composition and anticancer agent on the same day from independent routes of administration. The pharmaceutical composition and the second anticancer agent may also be administered through separate therapeutic courses and/or administered through the same therapeutic course on different days.

In another aspect of the present invention, a method of treating or preventing cancer in a patient is provided. The method has a step of administering any one of the pharmaceutical compositions of the present invention at a therapeutically effective amount to the patient. A therapeutically effective amount is an amount sufficient to elicit an immune response, especially to activate a subpopulation of CTL. Those skilled in the art can readily determine an effective amount by using a standard immunological method as provided in the Examples of the present specification. Another method of monitoring the effect of a specific amount of the pharmaceutical composition of the present invention is to observe the growth and/or recurrence of treated tumor.

In an especially preferred embodiment of the present invention, the pharmaceutical composition is used as an anticancer vaccine.

The composition comprising a peptide or a nucleic acid encoding the peptide of the present invention can constitute a tumor or cancer vaccine. The tumor or cancer vaccine can be administered directly to the organ with the disease or systemically into a patient, administered to the patient with a vaccine applied in vitro to a human cell line or a cell from the patient, or used in vitro to select a subpopulation from immune cells of a patient and readministered into the patient The composition of the present invention can be used as a vaccine or as a method of treating cancer. The cancer is oral cavity or pharyngeal cancer, gastrointestinal cancer, colon, rectal, or anal cancer, airway cancer, breast cancer, uterine, vaginal, or vulvar cancer, endometrial or ovarian cancer, male genital tract cancer, urethral cancer, bone and soft tissue cancer, Kaposi's sarcoma, skin melanoma, eye melanoma, nonmelanoma eye cancer, brain or central nervous system cancer, thyroid and other endocrine gland cancer, Hodgkin's lymphoma, non-Hodgkin's lymphoma, or myeloma, and preferably renal cancer, colorectal carcinoma, lung cancer, breast cancer, pancreatic cancer, prostate cancer, gastric cancer, brain cancer, GIST or glioblastoma. According to the present invention, the preferred amount of peptide can vary between about 0.1-100 mg in 500 µl solution, preferably about 0.1-1 mg, and most preferably about 300 µg-800 µg. In this regard, the term "about" refers to +/−10 percentage of a given value unless specifically noted otherwise. Those skilled in the art would be able to adjust the actual amount of peptide to be used based on several factors such as the immune status of an individual patient and/or the amount of TUMAP presented in a specific type of cancer. The peptide of the present invention may be provided in a suitable shape (sterilized solution or the like) other than a freeze-thaw peptide.

The pharmaceutical composition of the present invention having the peptide and/or nucleic acid according to the present invention is administered to a patient with adenoma or cancerous disease associated with each corresponding peptide or antigen. An immune response mediated by a T cell is triggered thereby. Preferably, the amount of expression vector in the pharmaceutical composition of the present invention, in the peptide (especially peptide associated with tumor) or nucleic acid of the pharmaceutical composition of the present invention, or the composition of the present invention is specific to the tissue, cancer, and/or patient.

In another embodiment of the present invention, the vaccine of the present invention is a nucleic acid vaccine. It is well known that a T cell response is elicited by inoculation of a nucleic acid vaccine such as a DNA vaccine encoding a polypeptide. The tumor or cancer vaccine can be administered directly to the organ with the disease or systemically into the patient, administered to the patient with a vaccine applied in vitro to a human cell line or a cell from the patient, or used in vitro to select a subpopulation from immune cells of a patient and readministered into the patient. When the nucleic acid is administered into a cell in vitro, it is useful in some cases to introduce cells such that an immunostimulatory cytokine such as interleukin-2 or GM-CSF is co-expressed. The nucleic acid can be substantially pure, combined with an immunostimulatory adjuvant, used in combination with an immunostimulatory cytokine, or coadministered with a suitable delivery system (e.g., liposome). The nucleic acid vaccine may be administered with an adjuvant described in relation to the above-described peptide vaccine. Preferably, the nucleic acid vaccine is administered without an adjuvant.

The polynucleotide of the present invention, in some cases, is substantially pure or comprised in a suitable vector or a delivery system. Suitable vectors and delivery systems included are viral, such as adenovirus, vaccinia virus, retrovirus, herpes virus, adeno-associated virus, or a plurality of virus element-containing hybrid based system. Non-viral delivery systems included are cationic lipids and cationic polymers well known in the technical field of DNA delivery. Physical delivery such as a "gene gun" can also be used. The peptide or a peptide encoded by the nucleic acid is in some cases a fusion protein, such as a fusion protein with an epitope from tetanus toxoid that simulates a CD4 position T cell.

Suitably, all peptides administered to the patient are sterilized and free of pyogenic substance. A naked DNA can be administered by an intramuscular, intradermal, or subcutaneous injection. Conveniently, the nucleic acid vaccine can have any nucleic acid delivery means.

Preferably, the nucleic acid, which is a DNA, can be delivered in a liposome or as a part of a viral vector delivery system.

It is preferable that a nucleic acid vaccine such as a DNA vaccine is administered into a muscle. A peptide vaccine is preferably administered s.c. or i.d. It is also preferable to administer the vaccine intradermally.

Expression of an encoded polypeptide and uptake of a nucleic acid by a professional antigen-presenting cell such as a dendritic cell are possibly a mechanism of priming of an immune response. Although there is a possibility that a dendritic cell is not introduced, it is still important as an expression peptide can be taken in from a cell introduced into the tissue ("cross-priming". Example: Thomas A M, Santarsiero L M, Lutz E R, Armstrong T D, Chen Y C, Huang L Q, Laheru D A, Goggins M, Hruban R H, Jaffee E M. Mesothelin-specific CD8(+) T cell responses provide evidence of in vivo cross-priming by antigen-presenting cells in vaccinated pancreatic cancer patients. J Exp Med. 2004 Aug. 2; 200(3): 297-306).

A cancer immune therapeutic method mediated by a polynucleotide is described in Conry et al (1996) Seminars in Oncology 23, 135-147; Condon et al (1996) Nature Medicine 2, 1122-1127; Gong et al (1997) Nature Medicine 3, 558-561; Zhai et al (1996) J. Immunol. 156, 700-710; Graham et al (1996) Int J. Cancer 65, 664-670; and Burchell et al (1996) 309-313 In: Breast Cancer, Advances in biology and therapeutics, Calvo et al (eds), John Libbey Eurotext, the entirety of all of which is incorporated herein by reference.

It is potentially useful in the present invention to administer the peptide or nucleic acid ex vivo and to have the vaccine of the present invention target a specific cell population such as antigen-presenting cells by selective purification of a specific cell population from a patient or use of a delivery system, targeting vector and injection site (for example, as described in Zhou et al (1995) Blood 86, 3295-3301; Roth et al (1996) Scand. J. Immunology 43, 646-651, dendritic cells can be sorted). For example, a targeting vector can have a tissue or tumor specific promoter for directing expression of an antigen at a suitable location.

The vaccine of the present invention may be dependent on the cancer type and condition of the disease specific to a patient receiving therapy, therapeutic regimen up to this point, immune status of the patient and naturally the HLA haplotype of the patient. Furthermore, the vaccine according to the present invention can comprise an individualized constituent element depending on individual needs of a specific patient. Examples thereof include expression of related TAA, personal side effect due to allergy or other therapy, and different amounts of peptide in accordance with adjustment for secondary therapy after a series of initial therapeutic plans for a specific patient.

The peptide of the present invention is not only useful in cancer therapy, but also in diagnosis. The peptide is generated from glioblastoma, and these peptides are identified to be absent from normal tissue. Thus, these peptides can be used to diagnose the presence of cancer.

A pathologist can use the presence of the peptide of the present invention in tissue biopsy to assist in the diagnosis of cancer. A pathologist can know whether the tissue is malignant, inflammatory or mostly affected by mass spectrometry or detection of a specific peptide of the present invention using an antibody, or another method well known in the art. The presence of a group of peptides of the present invention enables classification or sub-classification of affected tissue.

Detection of the peptide of the present invention in an affected tissue sample enables decision with respect to the benefits of a therapeutic method related to the immune system especially when it is known or anticipated that a T lymphocyte is associated with the action mechanism. Loss of MHC expression is a mechanism that is well understood, by which a malignant cell evades immune surveillance. Thus, the presence of the peptide of the present invention indicates that this mechanism is not utilized by the analyzed cell.

The peptide of the present invention can be used in the analysis of a lymphocyte response to the peptide of the present invention. For example, it is possible to analyze an antibody response or T cell response to the peptide of the present invention or the peptide of the present invention which is a complex with an MHC molecule. These lymphocyte responses can be used as a prognosis marker for determining a further therapeutic step. These responses can also be used as a surrogate marker in an immunotherapeutic approach attempting to elicit a lymphocyte response by different means such as a protein, nucleic acid, endogenous substance, or lymphocyte immune transfer vaccination. Under the setting of gene therapy, a lymphocyte response to the peptide of the present invention can be considered in assessing a side effect. Monitoring a lymphocyte response is possibly useful in a follow-up test after transplantation therapy, such as detection of graft-versus-host and host-versus-graft diseases.

The peptides of the preset invention can be used in generation and growth of antibodies specific to an MHC/peptide complex. They can be used in a therapeutic method to apply a toxin or a radioactive substance while targeting affected tissue. As another method of using such antibodies, the antibodies can be applied while targeting a radionuclide to affected tissue for use in an imaging method such as PET. This method of use can assist in detecting small metastasis or determining an accurate position and size of affected tissue. In addition, the peptides can be used in verification of diagnosis of cancer performed by a pathologist based on biopsy sample.

The present invention can be provided as a kit. As used herein, "kit" refers to a unit generally providing portions to be provided (e.g., testing agent, diagnostic agent, therapeutic agent, antibody, label, manual and the like) into two or more separate sections. This form of a kit is preferred when a composition that should not be provided in a mixed state and is preferably mixed immediately before use for safety or the like is intended to be provided. Such a kit advantageously comprises an instruction or manual describing how the provided portions (e.g., testing agent, diagnostic agent, or therapeutic agent) are used or how a reagent should be handled. When the kit is used herein as a reagent kit, the kit generally comprises an instruction describing how to use a testing agent, diagnostic agent, therapeutic agent, antibody and the like.

In this manner, in a further aspect of the present invention, the present invention is directed to a kit, wherein the kit has (a) a container comprising the pharmaceutical composition of the present invention in a solution form or a freeze-dried form, (b) selectively a second container comprising a diluent or a reconstitution solution for the freeze-dried formulation, and (c) selectively, a manual directed to (i) use of the solution or (ii) reconstitution and/or use of the freeze-dried formulation. The kit further has one or more of (iii) buffer, (iv) diluent, (v) filter, (vi) needle, or (v) syringe. The container is preferably a bottle, vial, syringe or a test tube or a multi-purpose container. The pharmaceutical composition is preferably freeze-dried.

The kit of the present invention preferably has a manual directed to the reconstitution and/or use of the freeze-dried formulation of the present invention in a suitable container. Examples of a suitable container include bottles, vials (e.g., dual chamber vials), syringe (dual chamber syringe and the like) and test tubes. The container can be formed from various materials such as glass or plastic. Preferably, the kit and/or container comprises a manual, on the container or accompanying the container, showing the method of reconstitution and/or use. For example, the label can explain that the freeze-dried formulation is reconstituted to the above-described peptide concentration. The label can further explain that the formulation is for subcutaneous injection or is useful for a subcutaneous injection.

The container of the formulation may be a multi-purpose vial that can be used in repeated administration (e.g., 2 to 6 administrations). The kit can further have a second container with a suitable diluent (e.g., sodium bicarbonate).

The final peptide concentration of a reconstituted formulation made by mixing the diluent and the freeze-dried formulation is preferably at least 0.15 mg/mL/peptide (=75 µg) and preferably 3 mg/mL/peptide (=1500 µg) or less. The kit can further comprise other materials that are desirable for commercial purpose or for users (including other buffer, diluent, filter, needle, syringe, and package insert).

The kit of the present invention can have a single container comprising a formulation of the pharmaceutical composition of the present invention with or without other constituent elements (e.g., other compounds or pharmaceutical composition of the other compounds). Alternatively, the kit can have separate containers for each constituent element.

Preferably, the kit of the present invention comprises a formulation of the present invention packaged for use as a combination with combined administration of a second compound (adjuvant (e.g., GM-CSF), chemotherapeutic agent, natural product, hormone or antagonist, anti-angiogenic agent or angiogenesis inhibitor, apoptosis inducer, chelating agent or the like) or a pharmaceutical composition thereof. The constituent element of the kit can be a complex made in advance or each constituent element can be placed in separate containers until administration to a patient. The constituent element of the kit can be provided as one or more liquid solutions, preferably as aqueous solutions, and more preferably sterilized aqueous solutions. The constituent elements of the kit can also be provided as a solid, which preferably can be converted into a liquid by adding a suitable solvent provided in another separate container thereto.

The container of a therapeutic kit can be a vial, test tube, flask, bottle, syringe or any other means for sealing a solid or a liquid. When there are a plurality of constituent elements, the kit generally comprises a second vial or another container such that the constituent elements can be administered separately. The kit can also comprise another container for a pharmaceutically acceptable liquid. Preferably, a therapeutic kit comprises an instrument (e.g., one or more needles, syringes, instillator, pipettes or the like) that enables administration of an agent of the present invention, which is the constituent element of the kit.

The pharmaceutical composition of the present invention is suitable for administering the peptide by any acceptable route such as oral (enteral), trans-nasal cavity, transocular, subcutaneous, intradermal, intramuscular, intravenous or transdermal route. The administration is preferably subcutaneous administration and most preferably intradermal administration. Administration can be performed with an infusion pump.

As used herein, "instruction" is a document with an explanation of the method of use of the present invention for a physician or other users. The instruction describes detection method of the present invention, method of use of a diagnostic agent, or sentences instructing administration of a medicament or the like. Further, an instruction may describe a sentence instructing oral administration or administration to the esophagus (e.g., by injection or the like) as a site of administration. The instruction is prepared in accordance with a format defined by an authority of the country in which the present invention is practiced (e.g., Health, Labor and Welfare Ministry in Japan or Food and Drug Administration (FDA) in the U.S. or the like), with an explicit description showing approval by the authority. The instruction is a so-called package insert and is typically provided in, but not limited to, paper media. The instructions may also be provided in a form such as electronic media (e.g., web sites provided on the Internet or emails).

(General Techniques)

Molecular biological technology, biochemical technology, and microbiological technology used herein are well known and conventional technologies in the art that are described in, for example, Sambrook J. et al. (1989). Molecular Cloning: A Laboratory Manual, Cold Spring Harbor and 3$^{rd}$ Ed. thereof (2001); Ausubel, F. M. (1987). Current Protocols in Molecular Biology, Greene Pub. Associates and Wiley-Interscience; Ausubel, F. M. (1989). Short Protocols in Molecular Biology: A Compendium of Methods from Current Protocols in Molecular Biology, Greene Pub. Associates and Wiley-Interscience; Innis, M. A. (1990). PCR Protocols: A Guide to Methods and Applications, Academic Press; Ausubel, F. M. (1992). Short Protocols in Molecular Biology: A Compendium of Methods from Current Protocols in Molecular Biology, Greene Pub. Associates; Ausubel, F. M. (1995). Short Protocols in Molecular Biology: A Compendium of Methods from Current Protocols in Molecular Biology, Greene Pub. Associates; Innis, M. A. et al. (1995). PCR Strategies, Academic Press; Ausubel, F. M. (1999). Short Protocols in Molecular Biology: A Compendium of Methods from Current Protocols in Molecular Biology, Wiley, and annual updates; Sninsky, J. J. et al. (1999). PCR Applications: Protocols for Functional Genomics, Academic Press, Gait, M. J. (1985). Oligonucleotide Synthesis: A Practical Approach, IRL Press; Gait, M. J. (1990). Oligonucleotide Synthesis: A Practical Approach, IRL Press; Eckstein, F. (1991). Oligonucleotides and Analogues: A Practical Approach, IRL Press; Adams, R. L. et al. (1992). The Biochemistry of the Nucleic Acids, Chapman & Hall; Shabarova, Z. et al. (1994). Advanced Organic Chemistry of Nucleic Acids, Weinheim; Blackburn, G. M. et al. (1996). Nucleic Acids in Chemistry and Biology, Oxford University Press; Hermanson, G. T. (1996). Bioconjugate Techniques, Academic Press, Bessatsu Jikken Igaku [*Experimental Medicine, Supplemental Volume*], Idenshi Donyu Oyobi Hatsugen Kaiseki Jikken Ho [*Experimental Methods for Transgenesis & Expression Analysis*], Yodosha, 1997, and the like, the relevant portions (which can be the entire document) of which are incorporated herein by reference.

Reference literatures such as scientific literatures, patents, and patent applications cited herein are incorporated herein by reference to the same extent that the entirety of each document is specifically described.

As described above, the present invention has been described while showing preferred embodiments to facilitate understanding. The present invention is described below based on Examples. The aforementioned description and the following Examples are not provided to limit the present invention, but for the sole purpose of exemplification. Thus, the scope of the present invention is not limited to the embodiments and Examples specifically described herein and is limited only by the scope of claims.

EXAMPLES

Examples of Preparation of Unbiasedly Amplified Sample

Preparation Example 1

Analysis of BCR Repertoire in Peripheral Blood of Healthy Individuals) the Present Example Performed BCR Repertoire Analysis on Peripheral Blood of Healthy Individuals (Materials and Methods)
Sample: Peripheral blood mononuclear cells of healthy individuals
Method:
(1. RNA Extraction)
5 mL of whole blood was collected from said healthy individuals in a heparin-containing blood collection tube. Peripheral blood mononuclear cells (PBMC) were separated by ficoll density gradient centrifugation. Total RNA was extracted/purified from the isolated $5 \times 10^6$ PBMCs by using RNeasy Lipid Tissue Mini Kit (QIAGEN, Germany). The resulting RNA was quantified by absorbance of A260 bp using an absorption spectrometer. The concentration was 232 ng/μL in 30 μL of eluate.
(2. Synthesis of Complementary DNA and Double Stranded Complementary DNA)
The extracted RNA sample was used to carry out adaptor-ligation PCR. First, in order to synthesize a complementary DNA, a BSL-18E primer (Table 1-1) and 3.5 μL (812 ng) of RNA were admixed and annealed for 8 minutes at 70° C. After cooling on ice, a reverse transcription reaction was performed in the presence of an RNase inhibitor (RNAsin) to synthesize a complementary DNA with the following composition.

TABLE 1-1A

Synthesis of complementary DNA

| Reagent | Content (μL) | Final concentration |
|---|---|---|
| RNA solution | 3.5 | |
| 200 μM BSL-18E | 1.5 | 30 μM |
| | Total 5 | 70° C., 8 minutes |
| 5x First strand buffer | 2 | 50 mM Tris-HCl, pH 8.3, 75 mM KCl, 3 mM MgCl$_2$ |
| 0.1M DTT | 1 | 10 mM |
| 10 mM dNTPs | 0.5 | 500 μM |
| RNasin (Promega) | 0.5 | 2 U/μL |
| Superscript III ™, 200 U/μL (Invitrogen) | 1 | 20 U/μL |

The complementary DNA was subsequently incubated for hours at 16° C. in the following double-stranded DNA synthesis buffer in the presence of E. coli DNA polymerase I, E. coli DNA Ligase, and RNase H to synthesize a double stranded complementary DNA. Furthermore, T4 DNA polymerase was reacted for 5 minutes at 16° C. to perform a 5' terminal blunting reaction.

TABLE 1-1B

Synthesis of complementary DNA

| Reagent | Content (μL) | Final concentration |
|---|---|---|
| Complementary DNA reaction solution | 9 | |
| Sterilized water | 46.5 | |
| 5x Second strand buffer | 15 | 25 mM Tris-HCl, pH 7.5, 100 mM KCl, 5 mM MgCl$_2$, 10 mM (NH$_4$)SO$_4$, 0.15 mM β-NAD+, 1.2 mM DTT |
| 10 mM dNTPs | 1.5 | 0.2 mM |
| E. coli DNA ligase, 10 U/μL (Invitrogen) | 0.5 | 0.067 U/μL |
| E. coli DNA polymerase, 10 U/μL (Invitrogen) | 2 | 0.27 U/μL |
| RNaseH, 2 U/μL (Invitrogen) | 0.5 | 0.013 U/μL |
| | Total 75 μL | 16° C., 2 hours |
| T4 DNA polymerase, 5 U/μL (Invitrogen) | 1 | 0.067 U/μL |
| | | 16° C., 5 minutes |

A double stranded DNA, after column purification by a High Pure PCR Cleanup Micro Kit (Roche), was incubated all night at 16° C. in the presence of a P20EA/10EA adaptor (Table 1-1) and T4 ligase in the following T4 ligase buffer for a ligation reaction.

TABLE 1-1

Primer sequences

| Primer | Sequence |
|---|---|
| BSL-18E | AAAGCGGCCGCATGCTTTTTTTTTTTTTTTTTVN (SEQ ID NO: 1) |
| P20EA | TAATACGACTCCGAATTCCC (SEQ ID NO: 2) |
| P10EA | GGGAATTCGG (SEQ ID NO: 3) |
| B-P20EA | Adaptor B-TAATACGACTCCGAATTCCC (SEQ ID NO: 4) |
| CM1 | TCCTGTGCGAGGCAGCCAA (SEQ ID NO: 5) |

TABLE 1-1-continued

Primer sequences

| Primer | Sequence |
|---|---|
| CM2 | GTATCCGACGGGGAATTCTC (SEQ ID NO: 6) |
| CM3-GS | Adaptor A (SEQ ID NO: 39)-key (TCAG)-MID1 (SEQ ID NO: 40)-AAAGGGTTGGGGCGGATGC (SEQ ID NO: 1387) (Entire primer is SEQ ID NO: 7) |
| CA1 | GCTGGCTGCTCGTGGTGTAC (SEQ ID NO: 8) |
| CA2 | GGGAAGTTTCTGGCGGTCACG (SEQ ID NO: 9) |
| CA3-GS | Adaptor A (SEQ ID NO: 39)-key (TCAG)-MID2 (SEQ ID NO: 41)-CCGCTTTCGCTCCAGGTCAC (SEQ ID NO: 1388) (Entire primer is SEQ ID NO: 10) |
| CG1 | CACCTTGGTGTTGCTGGGCTT (SEQ ID NO: 11) |
| CG2 | TCCTGAGGACTGTAGGACAGC (SEQ ID NO: 12) |
| CG3-GS | Adaptor A (SEQ ID NO: 39)-key (TCAG)-MID3 (SEQ ID NO: 42)-TGAGTTCCACGACACCGTCAC (SEQ ID NO: 1389) (Entire primer is SEQ ID NO: 13) |
| CD1 | GTCCCGTCTTTGTATCTCAG (SEQ ID NO: 14) |
| CD2 | TCTGTGTCCCCATGTACC (SEQ ID NO: 15) |
| CD3-GS | Adaptor A (SEQ ID NO: 39)-key (TCAG)-MID4 (SEQ ID NO: 43)-CCCAGTTATCAAGCATGCC (SEQ ID NO: 1390) (Entire primer is SEQ ID NO: 16) |
| CE1 | CATAGTGACCAGAGAGCG (SEQ ID NO: 17) |
| CE2 | GTGGCTGGTAAGGTCATAG (SEQ ID NO: 18) |
| CE3-GS | Adaptor A (SEQ ID NO: 39)-key (TCAG)-MID5 (SEQ ID NO: 44)-CATTGGAGGGAATGTTTTTG (SEQ ID NO: 1391) (Entire primer is SEQ ID NO: 19) |
| Adaptor A sequence | CCATCTCATCCCTGCGTGTCTCCGAC (SEQ ID NO: 39) |
| Adaptor B sequence | CCTATCCCCTGTGTGCCTTGGCAGTC (SEQ ID NO: 1375) |

*MID: tag sequence

TABLE 1-1C

Adaptor adding reaction

| Reagent | Content (μL) | Final concentration |
|---|---|---|
| Complementary double stranded DNA solution | 12.5 | |
| T4 ligase buffer | 5 | 50 mM Tris-HCl, pH 7.6, 1.0 mM MgCl$_2$, 1 mM ATP, 5% PEG5000, 1 mM DTT |
| 50 μM P20EA/10EA adaptor | 5 | 10 μM |
| T4 DNA ligase, 1 U/μL (Invitrogen) | 2.5 | 0.1 U/μL |
| Total | 25 | 16° C., all night |

An adaptor added double stranded DNA purified by a column as discussed above was digested by a NotI restriction enzyme (50 U/μL, Takara) with the following composition in order to remove an adaptor added to the 3' terminal.

TABLE 1-1D

Restriction enzyme treatment

| Reagent | Content (μL) | Final concentration |
|---|---|---|
| Complementary double stranded DNA solution | 34 | |
| 10x restriction enzyme buffer | 5 | 50 mM Tris-HCl, pH 7.5, 10 mM MgCl$_2$, 1 mM, 1 mM DTT, 100 mM NaCl |
| 0.1% BSA | 5 | 0.01% |
| 0.1% Triton X-100 | 5 | 0.01% |
| NotI, 50 U/μL (Takara) | 1 | 1 U/μL |
| Total | 50 | 37° C., 2 hours |

(3. PCR)

For the first PCR amplification from a double stranded complementary DNA (1$^{st}$ PCR), a common adaptor primer P20EA and each of the immunoglobulin isotype C region specific primer (CM1, CA1, CG1, CD1, and CE1) were used for 20 cycles, where each cycle consisted of 30 seconds at 95° C., 30 seconds at 55° C., and one minute at 72° C. with the following reaction composition. The primer sequences used are shown in Table 1-1.

TABLE 1-1E

1st PCR amplification reaction composition

| Reagent | Content (μL) | Final concentration |
|---|---|---|
| 2x ExTaq Premix (Takara) | 10 | 10 mM Tris-HCl (pH 8.3) |
| | | 50 mM KCl |
| | | 2 mM MgCl$_2$ |
| | | 0.2 mM dNTPs |
| | | 0.5 U ExTaq polymerase |
| 10 mM P20EA primer | 0.5 | 250 nM |
| 10 mM CM1, CA1, CG1, CD1 or CE1 primer | 0.5 | 250 nM |
| Double stranded complementary DNA | 2 | |
| Sterilized water | 7 | |

A 1$^{st}$ PCR amplicon, which is a product of the first PCR amplification reaction, was then used to perform nested PCR with the reaction composition shown below between a P20EA primer and each of the immunoglobulin isotype C region specific primers. 20 cycles of PCR were performed, where each cycle consisted of 30 seconds at 95° C., 30 seconds at 55° C., and one minute at 72° C. The primer sequences used are shown in Table 1-1.

TABLE 1-1F

2$^{nd}$ PCR amplification reaction composition

| Reagent | Content (μL) | Final concentration |
|---|---|---|
| 2x ExTaq Premix Takara) | 10 | 10 mM Tris-HCl (pH 8.3) |
| | | 50 mM KCl |
| | | 2 mM MgCl$_2$ |
| | | 0.2 mM dNTPs |
| | | 0.5 U ExTaq polymerase |
| 10 mM P20EA primer | 1 | 500 nM |
| 10 mM CM2(CA2, CG2, CD2 or CE2) primer | 1 | 500 nM |
| 1$^{st}$ PCR amplicon | 2 | |
| Sterilized water | 6 | |

Column purification was performed with a High Pure PCR Cleanup Micro Kit (Roche) to remove a primer from a 2$^{nd}$ PCR amplicon, which is a product obtained from the second PCR amplification reaction. Subsequently, PCR was performed with the following reaction composition by using a B-P20EA primer, which is a P20EA primer added with an adaptor B sequence, and a GS-PCR primer, which is C region specific primer of each immunoglobulin added with an adaptor A sequence and identification sequence MID Tag sequence, with the 2$^{nd}$ PCR amplicon as a template. 10 cycles of PCR were performed, where each cycle consisted of 30 seconds at 95° C., seconds at 55° C., and one minute at 72° C. The primer sequences used are shown in Table 1-1.

TABLE 1-1G

GS-PCR (3$^{rd}$ PCR) amplification reaction composition

| Reagent | Content (μL) | Final concentration |
|---|---|---|
| 2x ExTaq Premix (Takara) | 10 | 10 mM Tris-HCl (pH 8.3) |
| | | 50 mM KCl |
| | | 2 mM MgCl$_2$ |
| | | 0.2 mM dNTPs |
| | | 0.5 U ExTaq polymerase |
| 10 mM B-P20EA primer | 1 | 500 nM |
| 10 mM CM3-GSPCR, CA3-GSPCR, CG3-GSPCR, CD3-GSPCR or: CE3-GSPCR primer | 1 | 500 nM |
| 2$^{nd}$ PCR amplicon after column purification | 1 | |
| Sterilized water | 7 | |

(4. Next Generation Sequencing)

After GS-PCR amplification under the optimal condition, 2% agarose gel electrophoresis was performed. When visualized, a band was cut out in a size of interest (500 bp-700 bp) and purified by using a DNA purification kit (QIAEX II Gel Extraction Kit, QIAGEN). The amount of collected DNA was measured by using a Quant-iT™ PicoGreen® dsDNA Assay Kit (Invitrogen). The amounts of DNA collected in an amplicon derived from each isotype were IgM (1611 ng/mL), IgG (955 ng/mL), IgA (796 ng/mL), IgD (258 ng/mL), and IgE (871 ng/mL). They were mixed so that the amount of DNA of isotype amplicons would be equal. 10 million DNAs were used in emulsion PCR for sequence analysis with Roche's next generation sequence analyzer (GS Junior Bench Top system).

(5. Data Analysis)

Sequence read analysis assigned V, D, J, and C sequences of each read sequence by using V, D, J, and C sequences obtained from the IMGT (the international ImMunoGeneTics information system, http colon+//www dot-imgt dot-org) database as reference sequences. IMGT's HighV-Quest and newly developed repertoire analysis software (Repertoire Genesis, see the patent application concurrently filed. The content thereof is incorporated herein by reference) were used for the assignment.

FIG. 1 shows cross-reactivity of isotype specific primers. In order to assess the specificity of the immunoglobulin isotype specific primers that were used, amplification was performed with an immunoglobulin isotype specific primer of interest as well as another isotype specific primer to verify the presence of cross-reactivity. 10 μL of GS-PCR amplicon was subjected to electrophoresis with 2% agarose gel in a TAE buffer, and then assessed by ethidium bromide staining. A 2$^{nd}$ PCR amplicon amplified with each isotype specific primer was not amplified with another isotype specific GS-PCR primer, verifying the high level of specificity of the primers.

Figure 2:
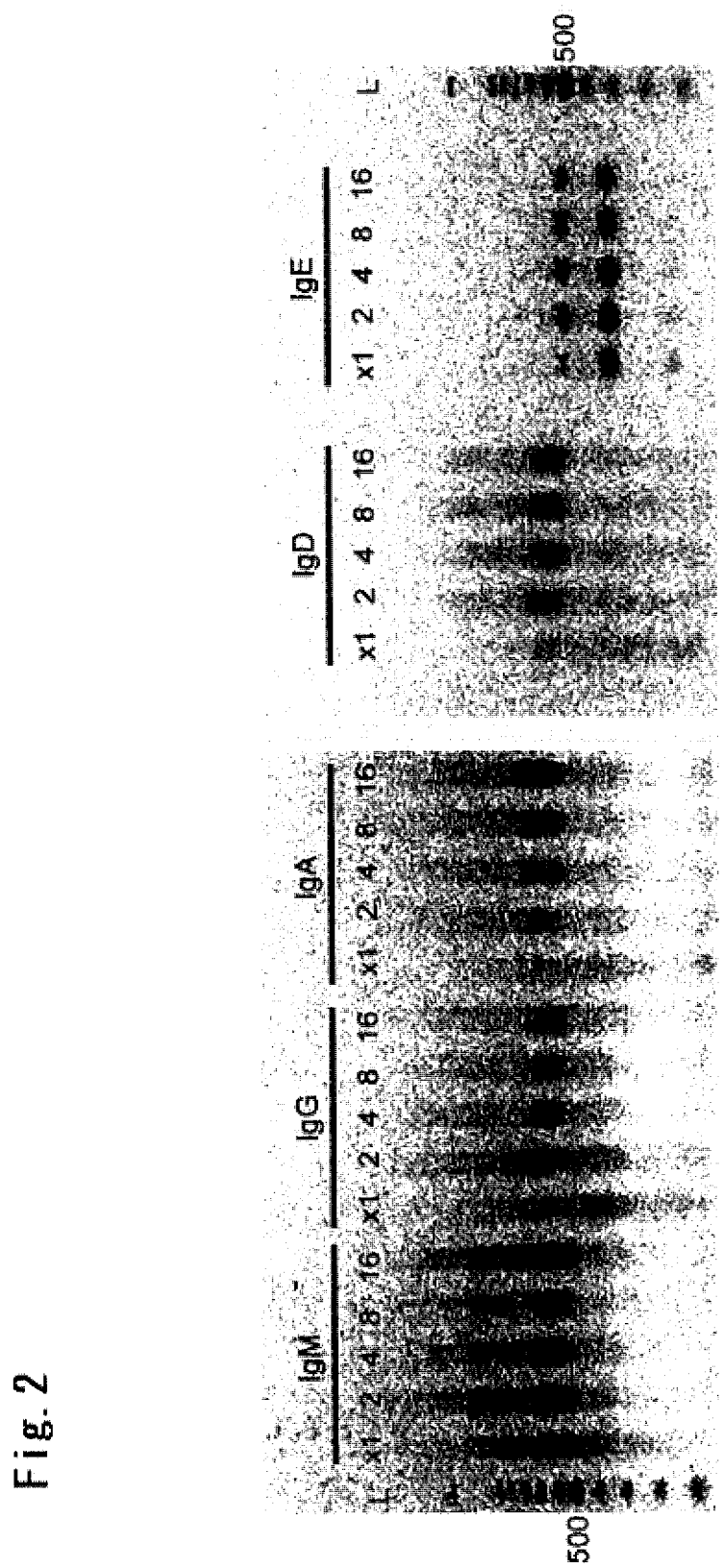
FIG. 2 shows results of studying the optimal dilution concentration. A GS-PCR optimal condition for each isotype was studied. 2-fold serial dilution system of a $2^{nd}$ PCR amplicon was created to perform 20 cycles of GS-PCR. The results are shown, from the left, for 1, 2, 4, 8, and 16-fold dilutions of IgM, IgG, IgA, IgD, and IgE for the $2^{nd}$ PCR amplicon. L on the left end shows a lane for a molecular weight marker. Excellent results were obtained for 16-fold dilution.

FIG. 2 shows results of studying the optimal dilution concentration. A GS-PCR optimal condition for each isotype was studied. A 2-fold serial dilution system of 2$^{nd}$ PCR amplicons was created to perform 20 cycles of GS-PCR. Excellent results were obtained for 16-fold dilution.

Figure 3:
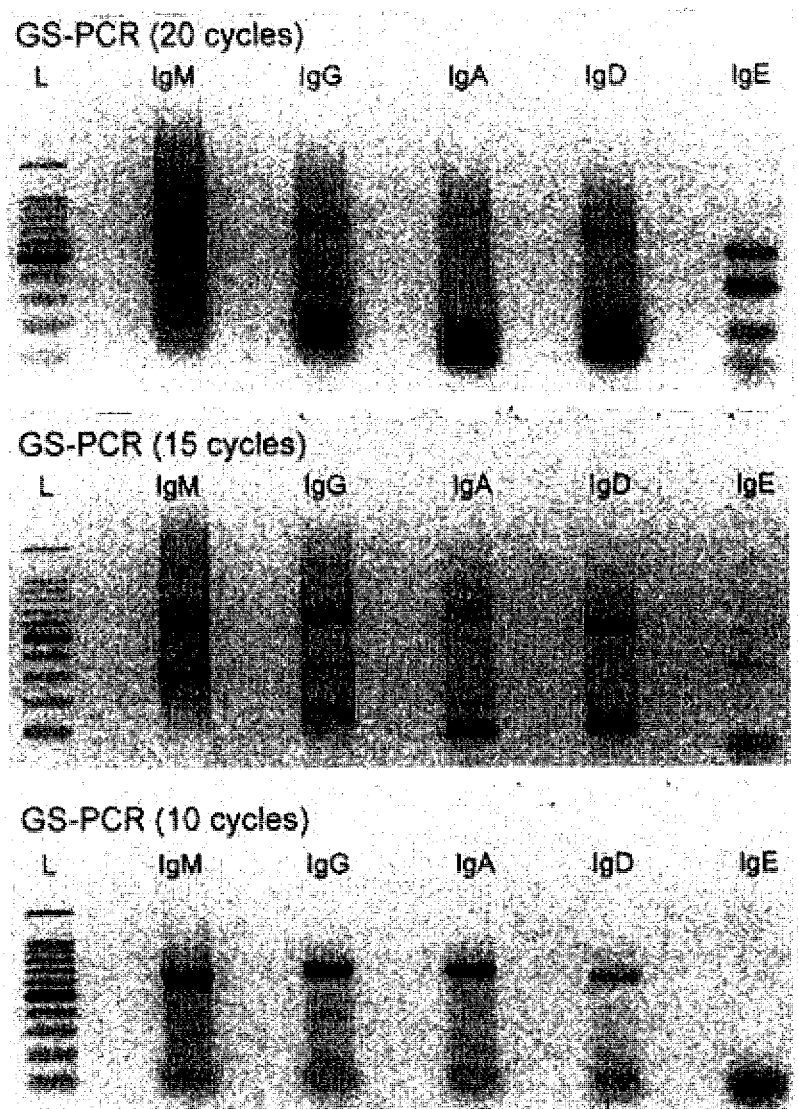
FIG. 3 shows results of studying the optimal number of cycles. 16-fold dilution $2^{nd}$ PCR amplicons were used for 10, 15, and 20 cycle PCR. The top panel shows the results for 20 cycles, the middle panel shows the results for 15 cycles, and the bottom panel shows the results for 10 cycles. Each panel shows L at the left end, indicating a lane for molecular weight markers, and shows, from the left, IgM, IgG, IgA, IgD and IgE. For IgM, IgG, IgA, and IgD, excellent amplification was confirmed with 10 cycles. Further, it was confirmed that 20 cycles were appropriate for IgE.

FIG. 3 shows results of studying the optimal number of cycles. 16-fold dilution 2$^{nd}$ PCR amplicons were used for 10, 15, and 20 cycles PCR. For IgM, IgG, IgA, and IgD, excellent amplification was confirmed with 10 cycles. Further, it was confirmed that 20 cycles were appropriate for IgE.

Figure 4:
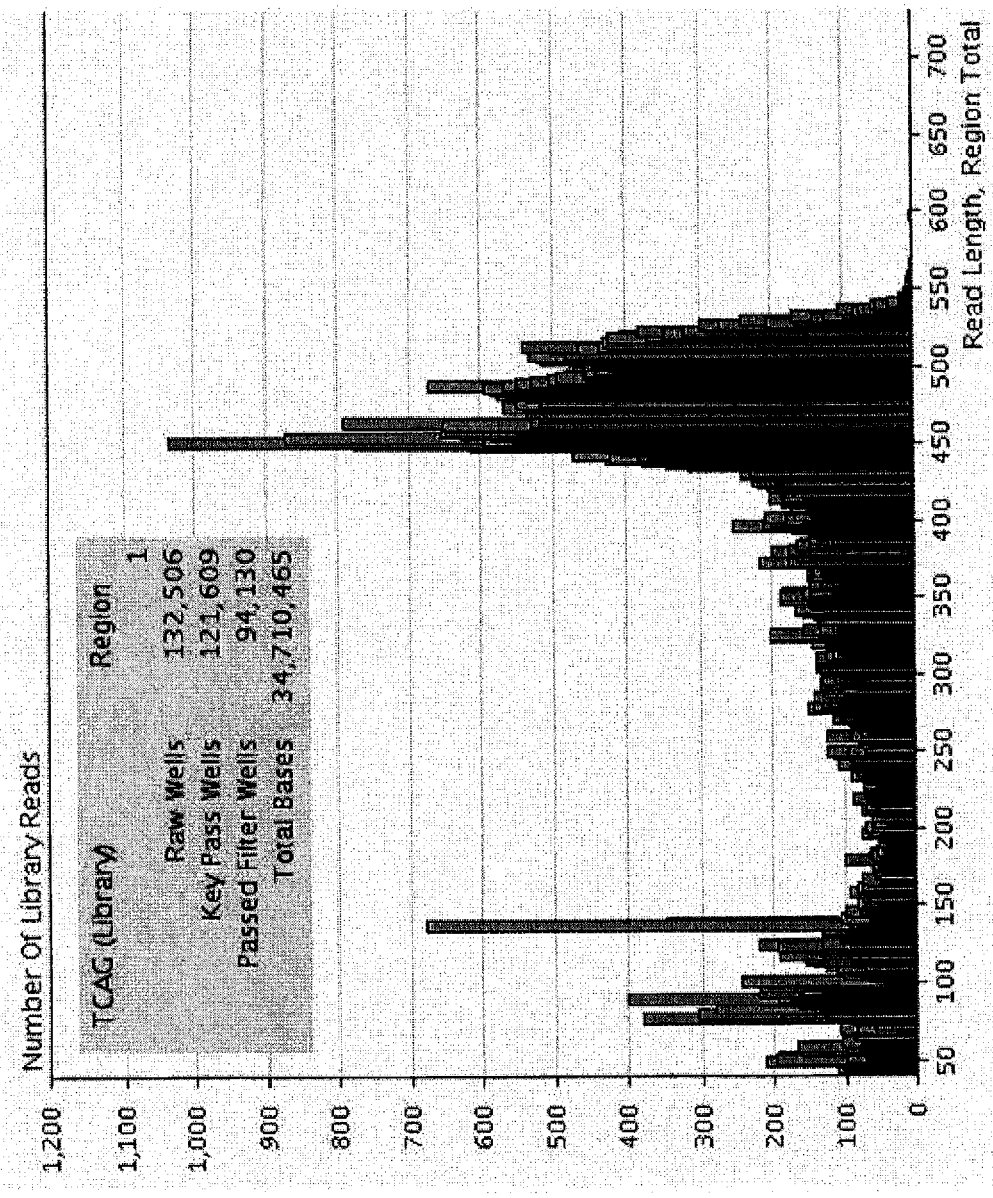
FIG. 4 shows the read length from next generation sequencing. The graph shows the number of library reads (vertical axis) and the horizontal axis indicates the result of analyzing the read length. The read lengths from next generation sequencing of a BCR gene are shown. The number of reads in Raw data was 130000, and more than 90000 reads that have gone through Filter pass were obtained. Table 2 shows the number of reads from each isotype that was labeled with a Tag.

FIG. 4 shows the read length from next generation sequencing. The read length from next generation sequencing of a BCR gene is shown in FIG. 4. The number of reads in Raw data is 130,000, and more than 90,000 reads that has gone through Filter pass were obtained. Table 1-2 shows the number of reads from each isotype that was labeled with a Tag.

TABLE 1-2

Number of reads for each isotype

| MID Tag | Isotype | Reads |
|---|---|---|
| MID1 | IgM | 22267 |
| MID2 | IgG | 18031 |
| MID3 | IgA | 15964 |
| MID4 | IgD | 22248 |
| MID5 | IgE | 15219 |

Figure 5:
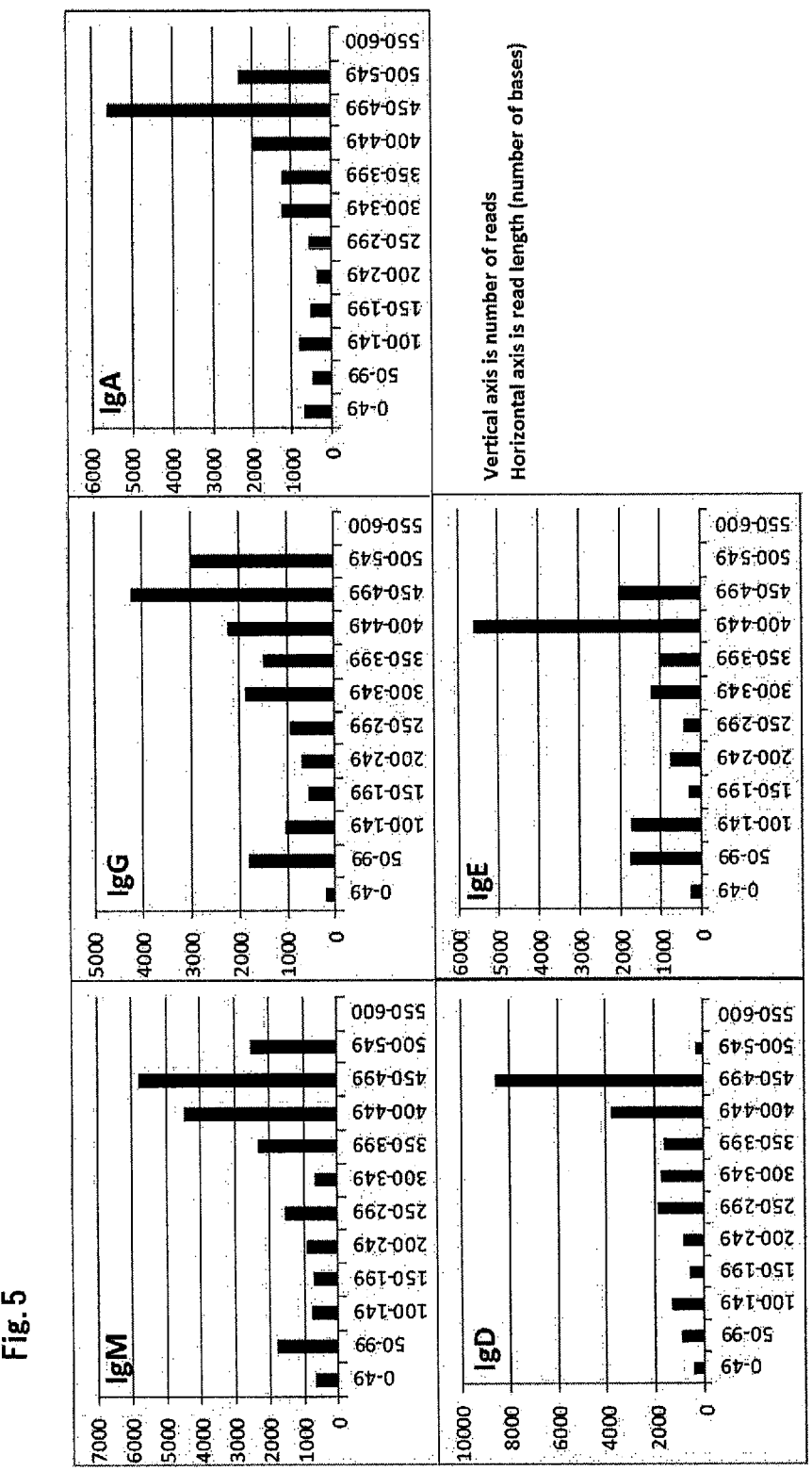
FIG. 5 shows results of analyzing read lengths for each MID. The top panel shows, from the left, IgM, IgG and IgA. The bottom panel shows, from the left, IgD and IgE. In each graph, the vertical axis indicates the number of reads and the horizontal axis indicates the read length (base length). The distributions of read length and number of reads divided into each MID were equal. When counted while setting the read length sufficient for analyzing a V region as 400 bp or greater, half of the reads, about 10000 reads, were considered effective for BCR repertoire analysis.

FIG. 5 shows the read length of each MID. The read length and number of reads divided for each MID were evenly distributed. When counted while setting the read length sufficient for analyzing a V region as 400 bp or greater, half of the reads, about 10000 reads, were considered effective for BCR repertoire analysis.

Figure 6A:
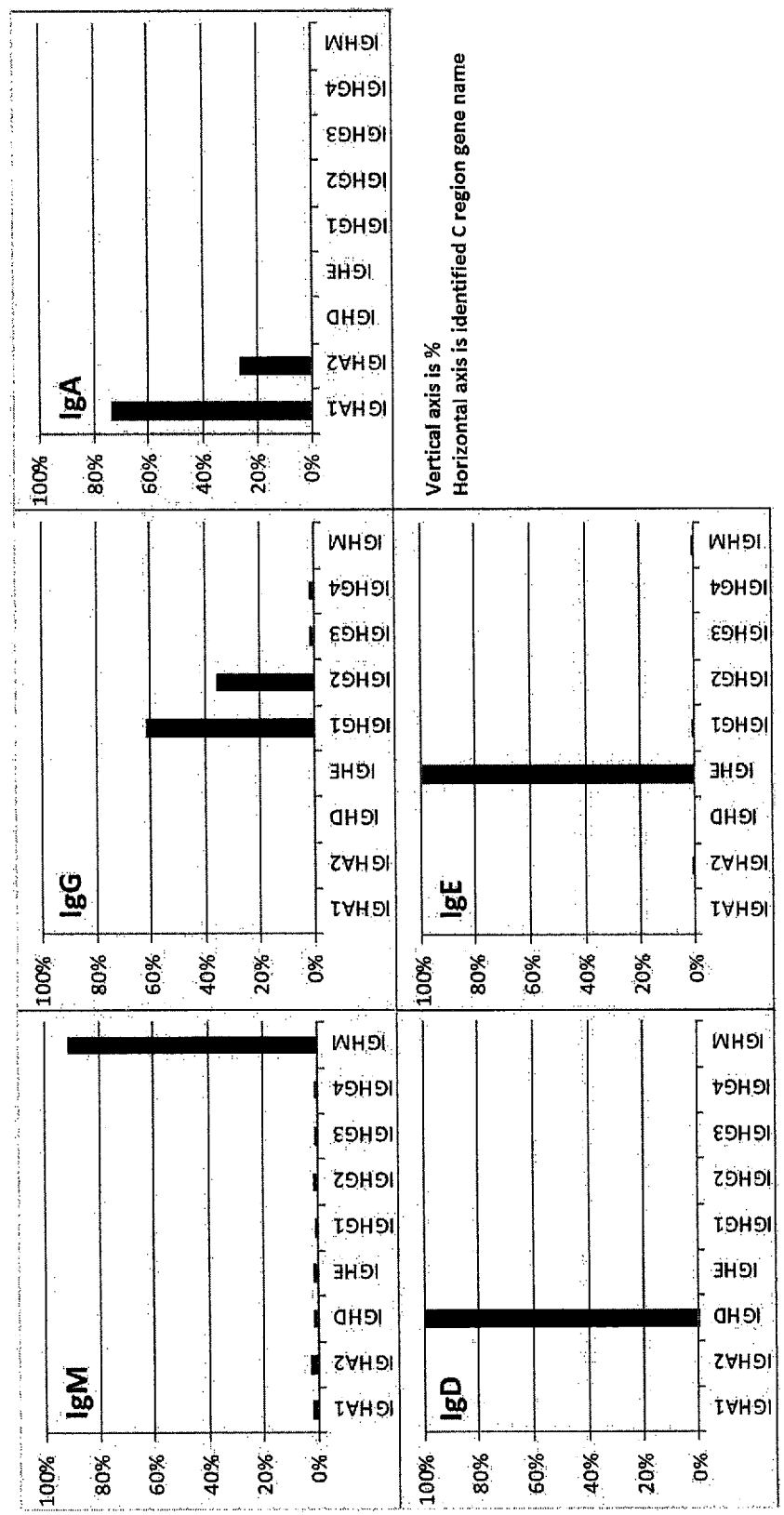
FIG. 6A shows results of analyzing usage frequency of C region sequences for each isotype. The top panel shows, from the left, IgM, IgG and IgA. The bottom panel shows, from the left, IgD and IgE. In each graph, the vertical axis indicates %, and the horizontal axis indicates the identified C region gene name. Search for homology with a C region sequence of an immunoglobulin isotype including subclasses was performed on the obtained reads for each isotype. The frequency of number of reads for each subclass was 73% for IgA1 and 27% for IgA2 in the IgA subclass, 62% for IgG1 and 36% for IgG2, while hardly any reads were obtained for IgG3 or IgG4 in the IgG subclass. Further, since obtained reads for each subclass were rarely classified into other classes, primer specificity was reconfirmed at the sequence level.
Figure 6B:
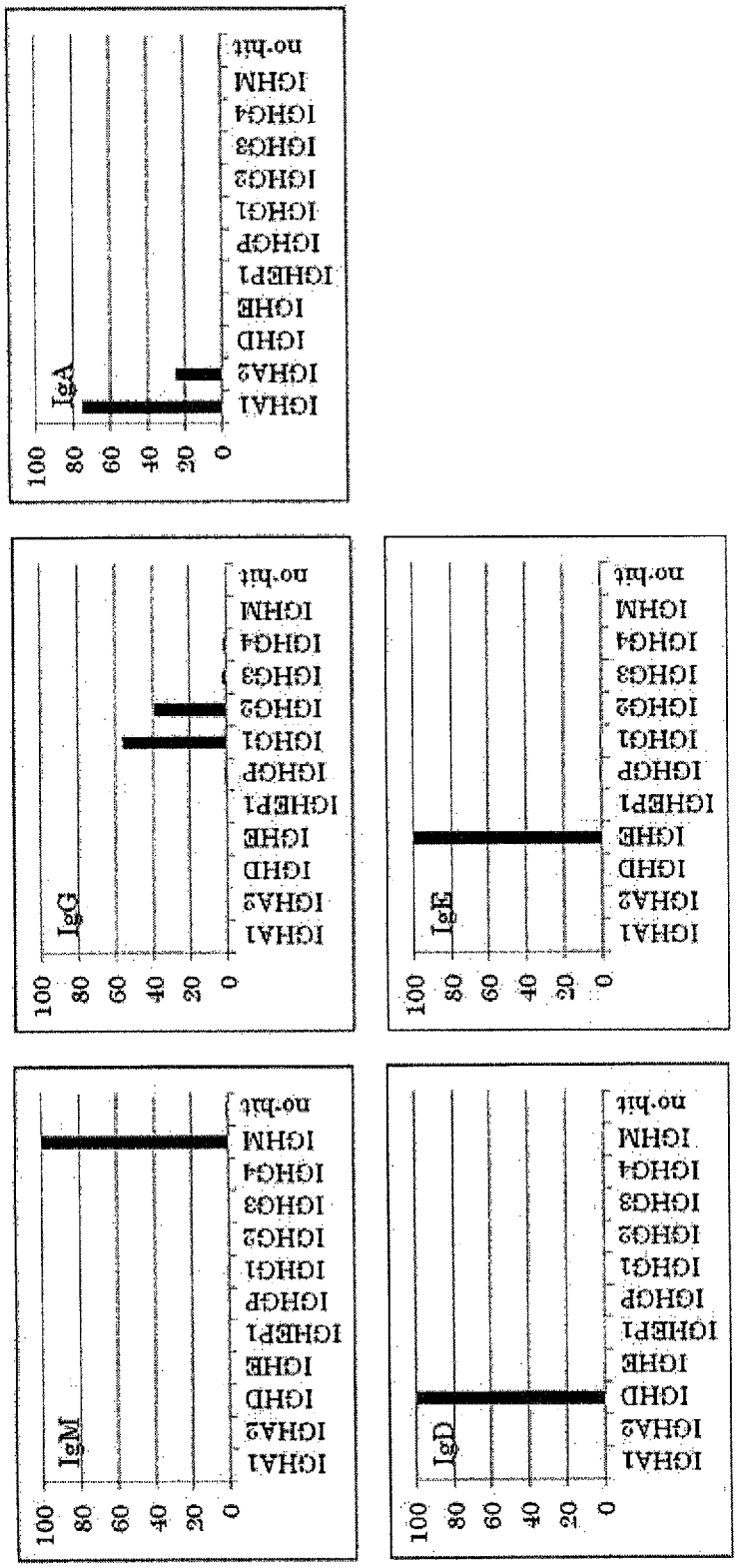
FIG. 6B shows results of analysis similar to FIG. 6A with an improved software (Repertoire genesis). Similar results were also obtained with this software. Furthermore, it was also possible to obtain a result of no hit, which indicates a read that is not classified in any isotype or subtype.
Figure 7A:
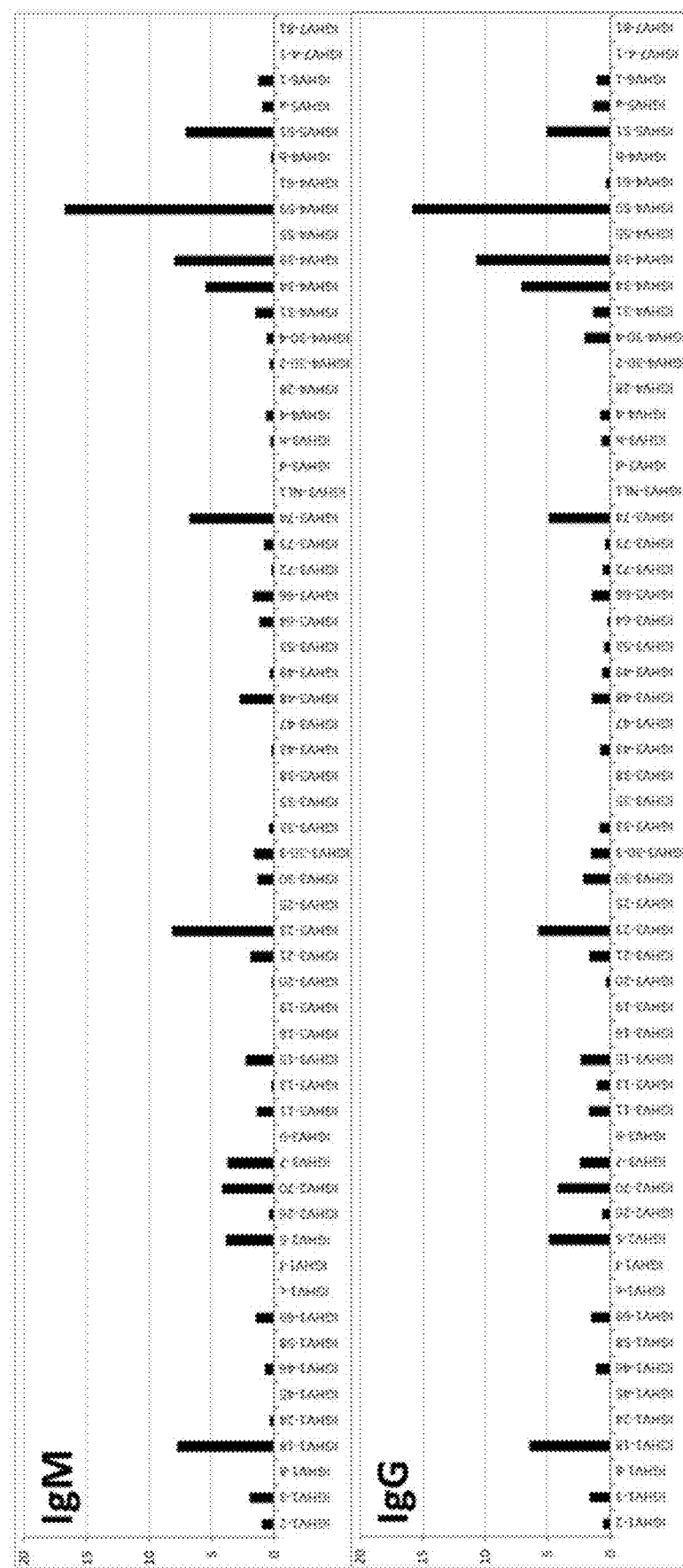
FIGS. 7A and 7B show results of analyzing a V region repertoire for each isotype. Each of IgM, IgG, IgA, IgD and IgE is shown from the top. The horizontal axis indicates the name of each isotype. A repertoire of a V region sequence for each isotype (BCR V repertoire) is shown. BCR V repertoires were very similar among IgM, IgG, IgA, and IgD, but only a read having IGHV3-30 was obtained for IgE. A reason therefor is suggested to be the possibility that there are much fewer number of IgE positive cells in the peripheral blood relative to other classes and therefore a biased repertoire was detected.
Figure 7B:
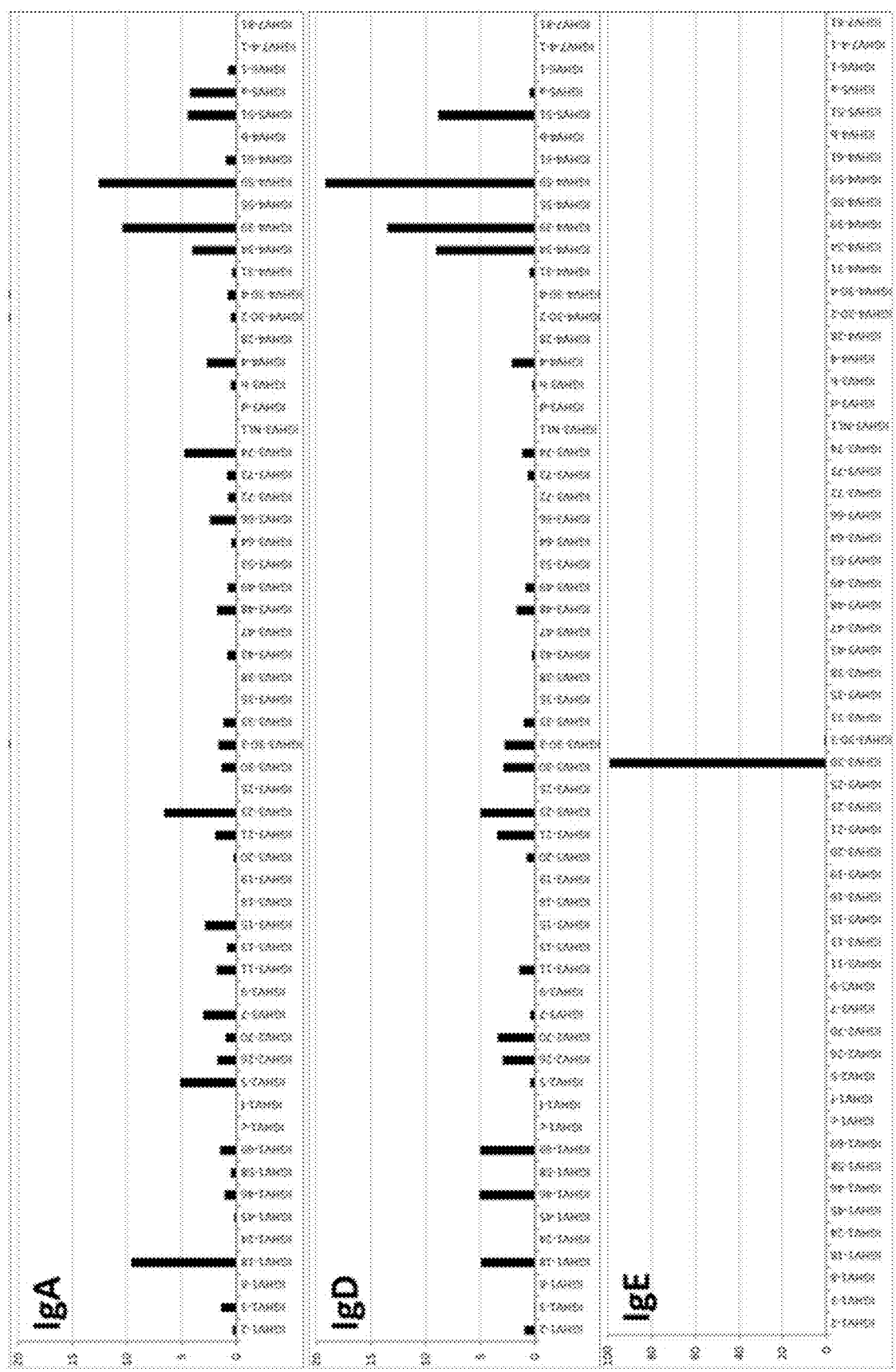
Figure 7C:
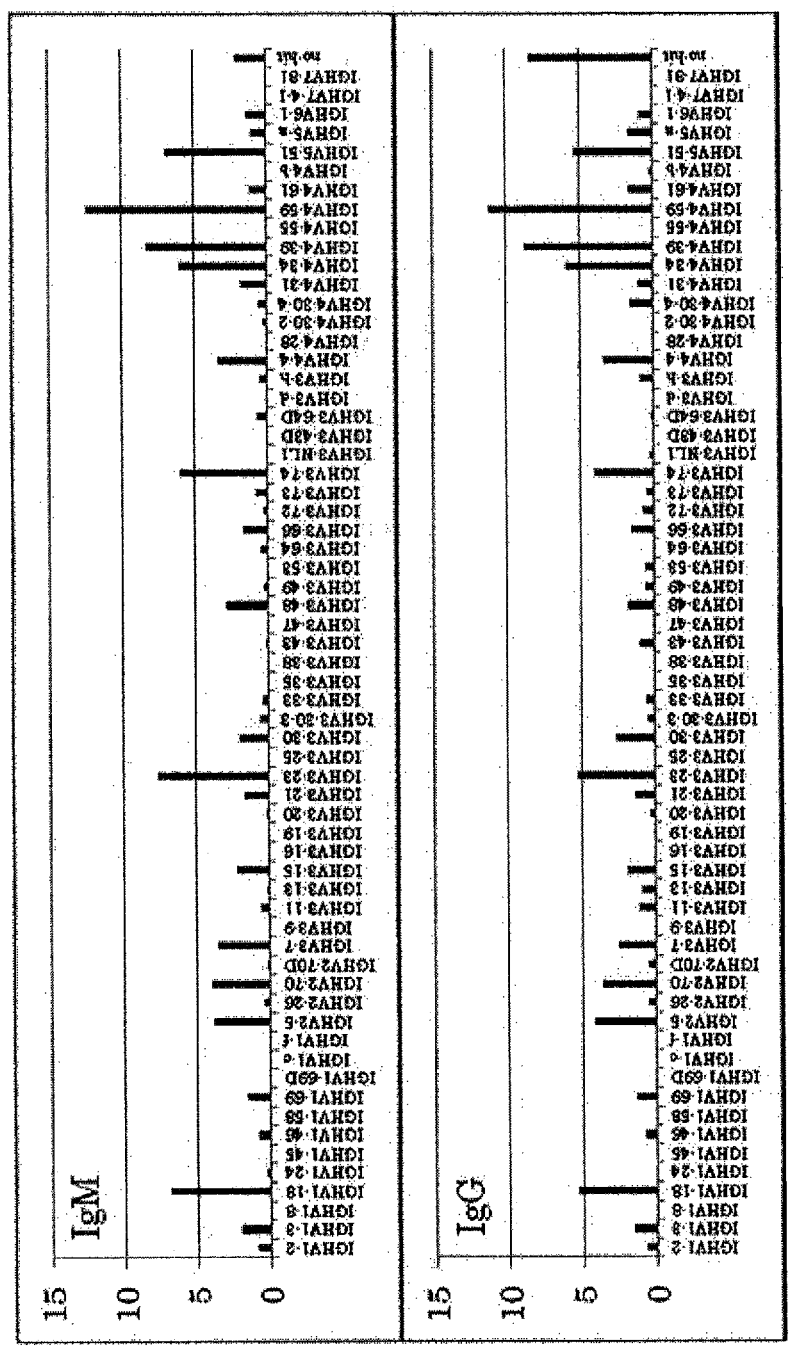
FIGS. 7C and 7D show results of analysis similar to FIGS. 7A and 7B with an improved software (Repertoire genesis). Similar results were also obtained with this software. Furthermore, it was also possible to obtain a result of no hit.
Figure 7D:
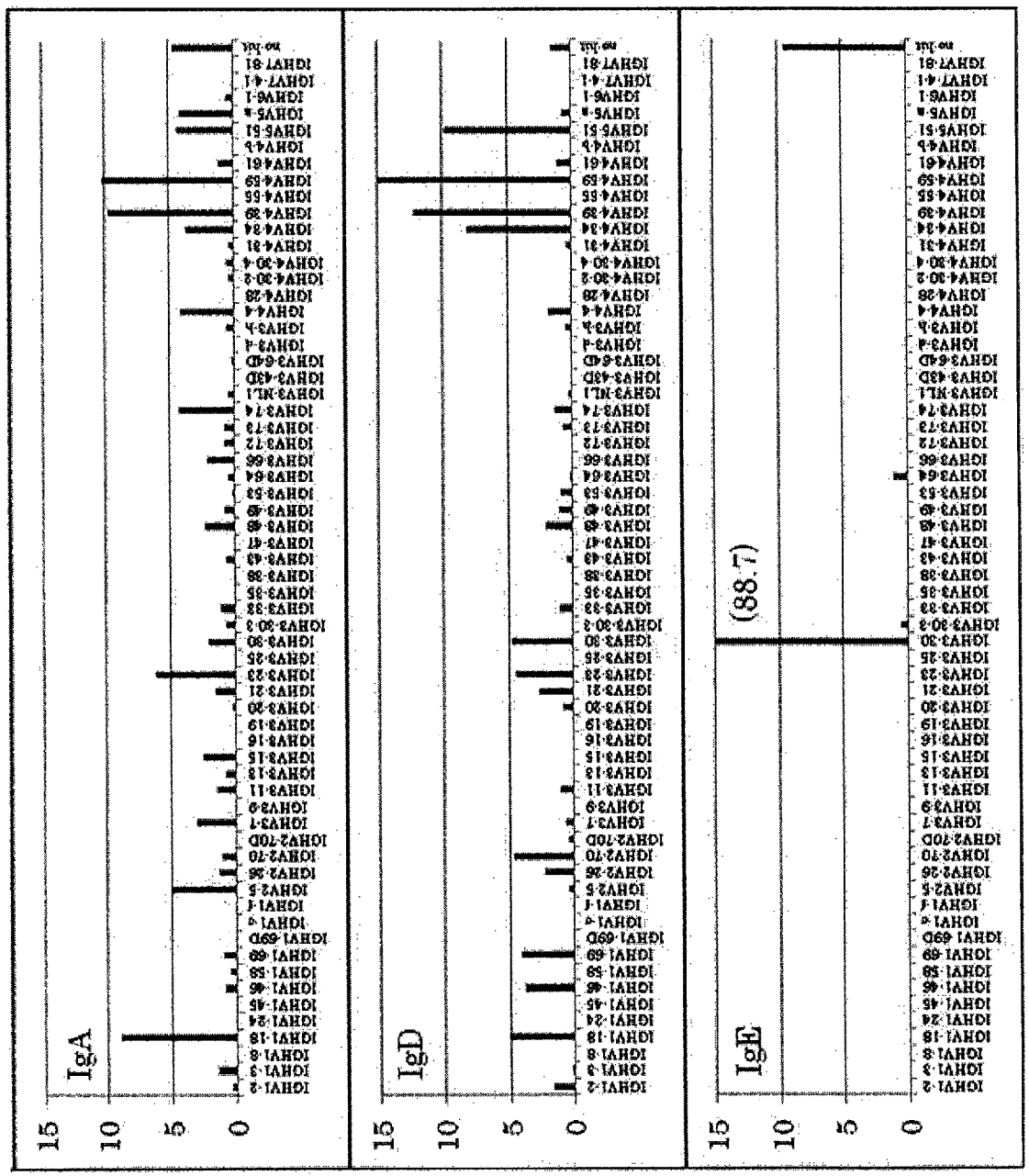
Figure 8A:
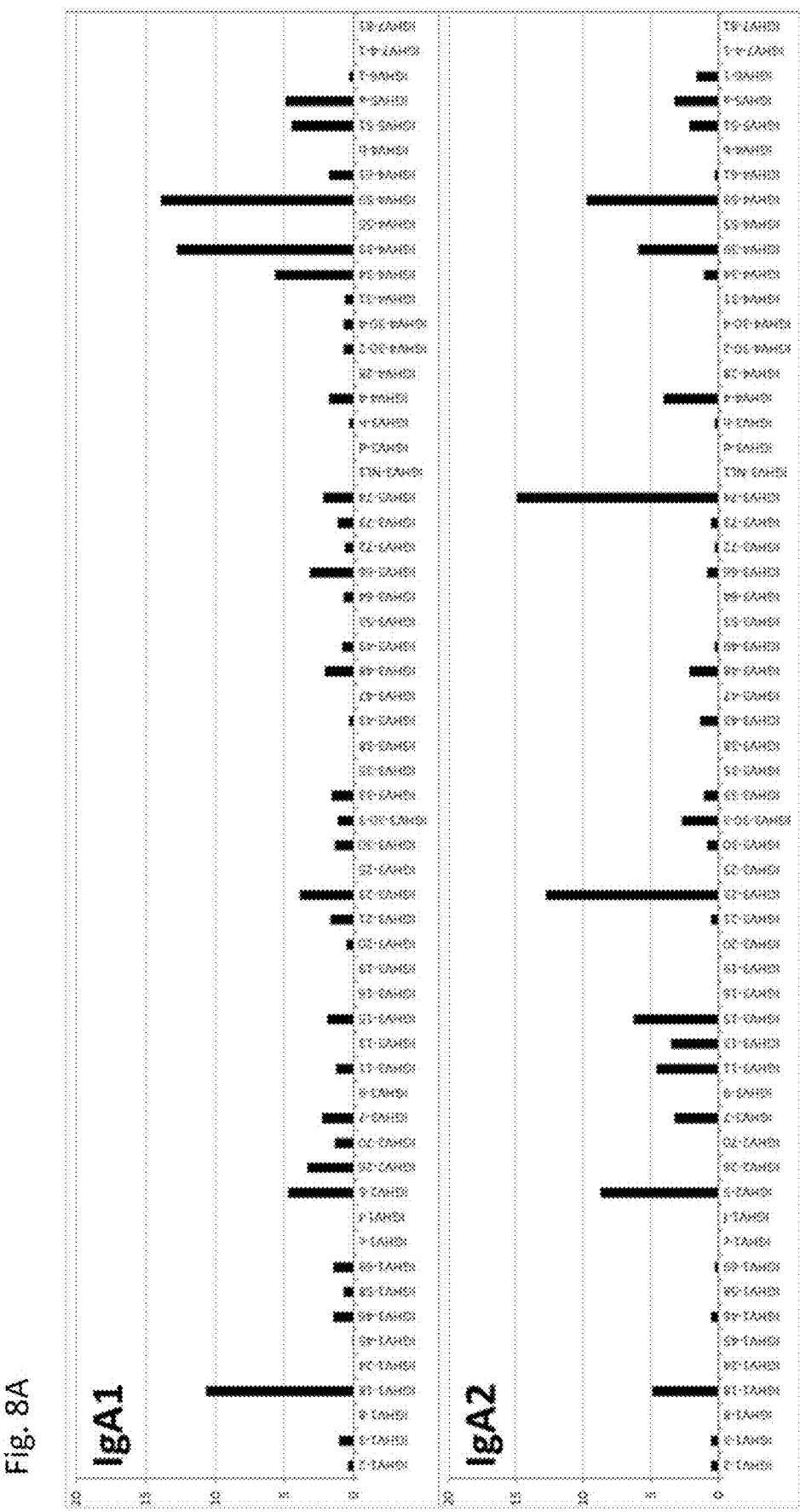
FIGS. 8A and 8B show results of analyzing a V region repertoire for each subtype. From the top, IgA1, IgA2, IgG1 and IgG2 are shown. The horizontal axis indicates each isotype name of each subclass. A BCR V repertoire is shown for each of IgA and IgG subclasses. The IgA subclass had different frequencies in several types of V chains between IgA1 and IgA2. The frequency of presence of IGHV1-18 and IGHV4-39 was higher in IgA1 compared to that in IgA2, while the frequency of presence of IGHV3-23 and IGHV3-74 was higher in IgA2 than that in IgA1. For the IgG subclass, the frequency of IGHV3-23 and IGHV3-74, which were found to be increased in IgA2, was higher in IgG2 compared to that in IgG1. There were few reads for IgG3 and IgG4 (10 reads). The frequency of clones with IGHV4-59-1GHJ4-IGHD1-7 was 3/10 in IgG3, thus having high clonality. Reads with IGHV3-23-IGHJ4-IGHD3-10 accounted for 5/10 for IgG4 (Table 1-3).
Figure 8B:
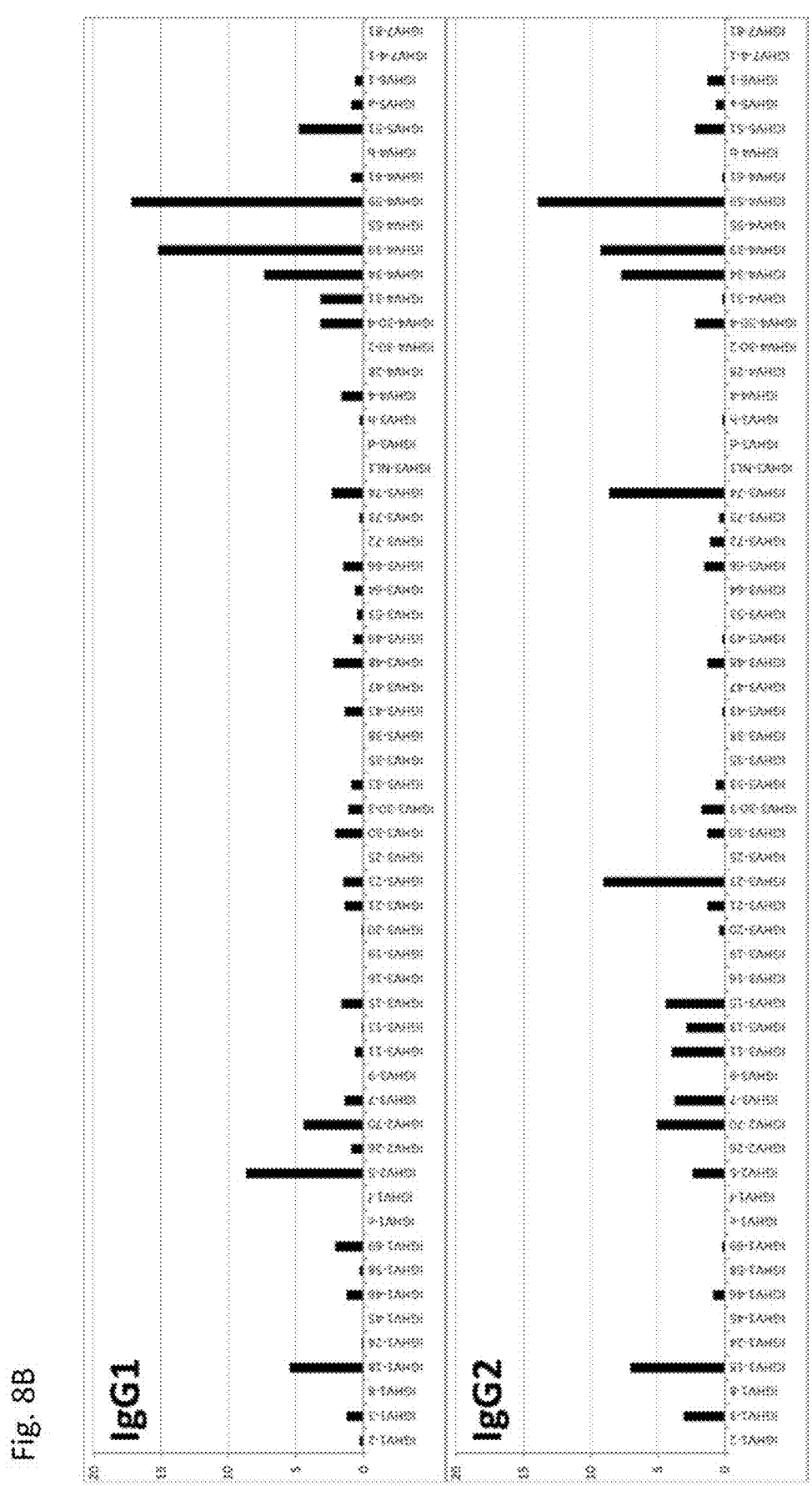
Figure 8C:
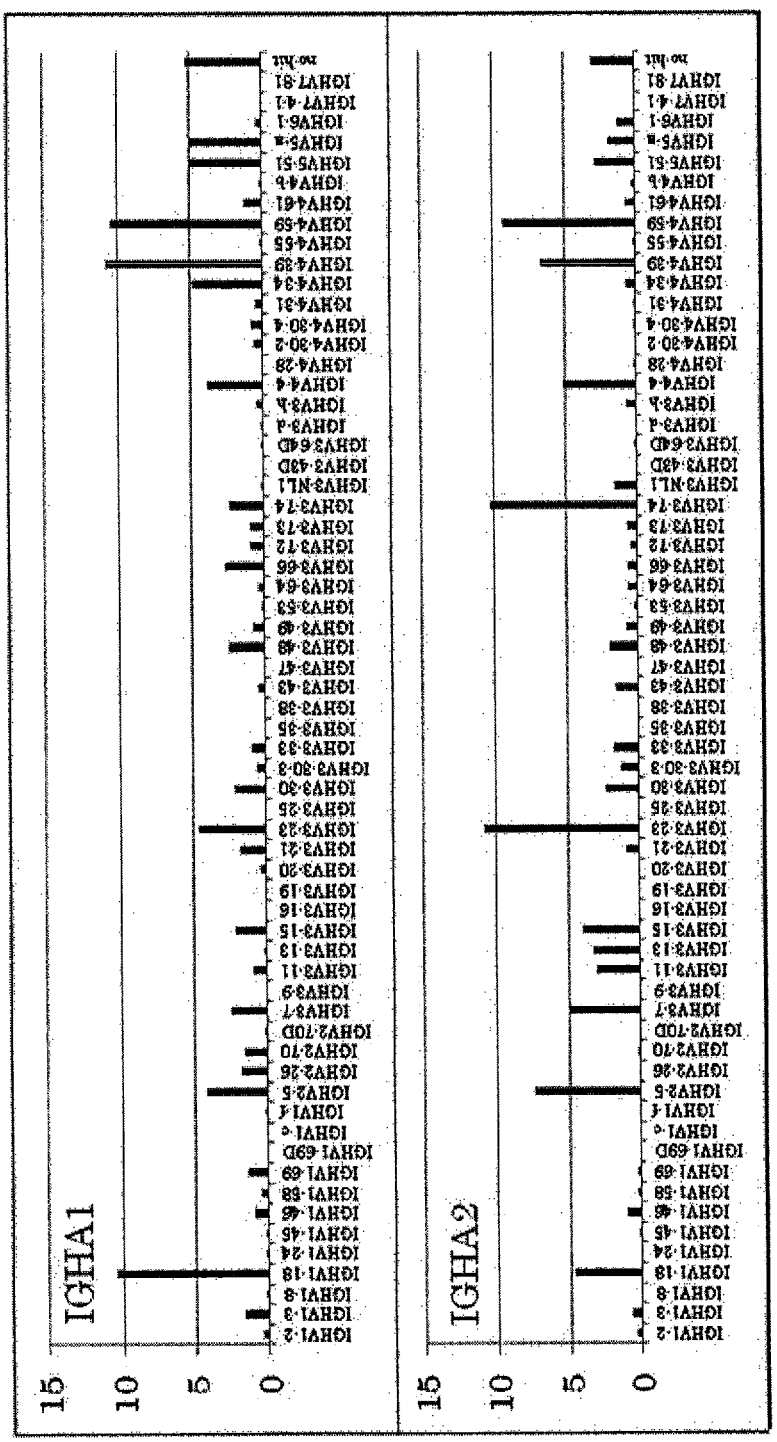
FIGS. 8C and 8D show results of analysis similar to FIGS. 8A and 8B with an improved software (Repertoire genesis). Similar results were also obtained with this software. Furthermore, it was also possible to obtain a result of no hit.
Figure 8D:
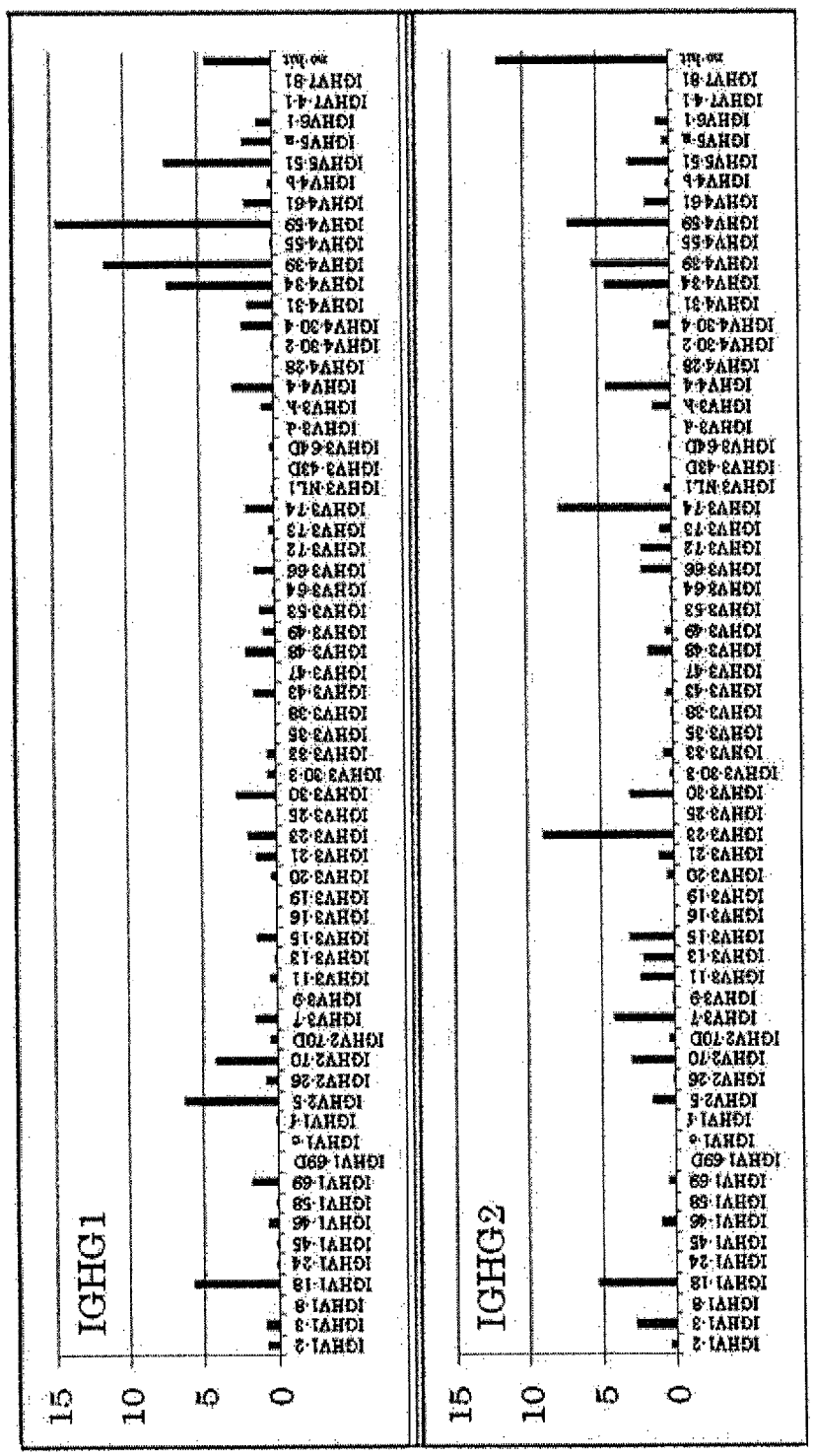
Figure 9A:
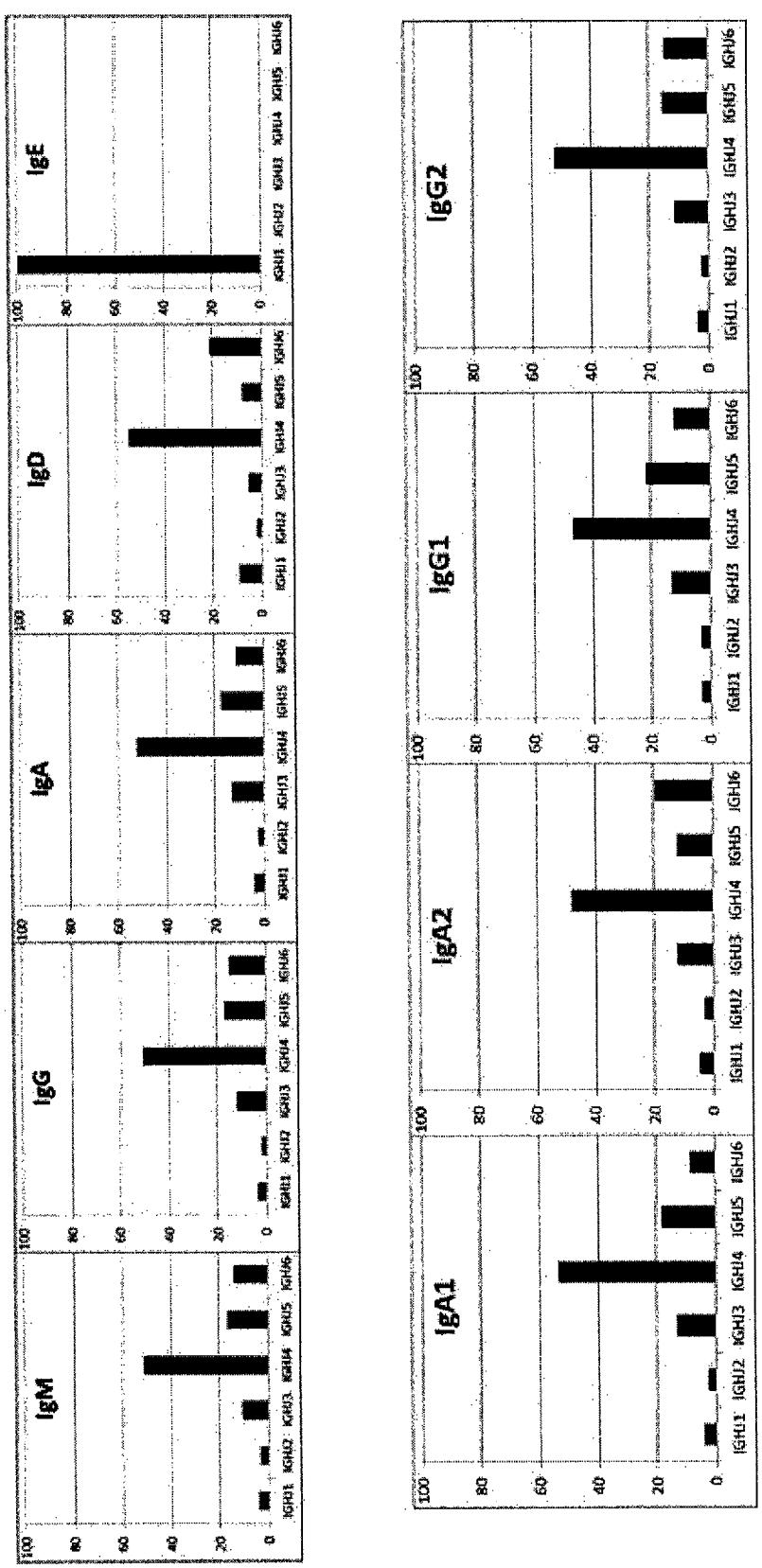
FIG. 9A shows results of analysis of a BCRJ repertoire for each subclass. A BCRJ repertoire for each subclass is shown. The top panel shows each of IgM, IgG, IgA, IgD and IgE. The horizontal axis indicates each isotype name. The bottom panel is a display for each subclass. From the left, IgA1, IgA2, IgG1 and IgG2 are shown. The horizontal axis indicates each isotype name of each subclass. IGHJ4 was used in about half of the reads in IgM, IgG, IgA and IgD, while IGHJ2 was hardly used. Only IGHJ1 was used in IgE. An IGHJ repertoire in subclasses of IgM and IgA was also studied.
Figure 9B:
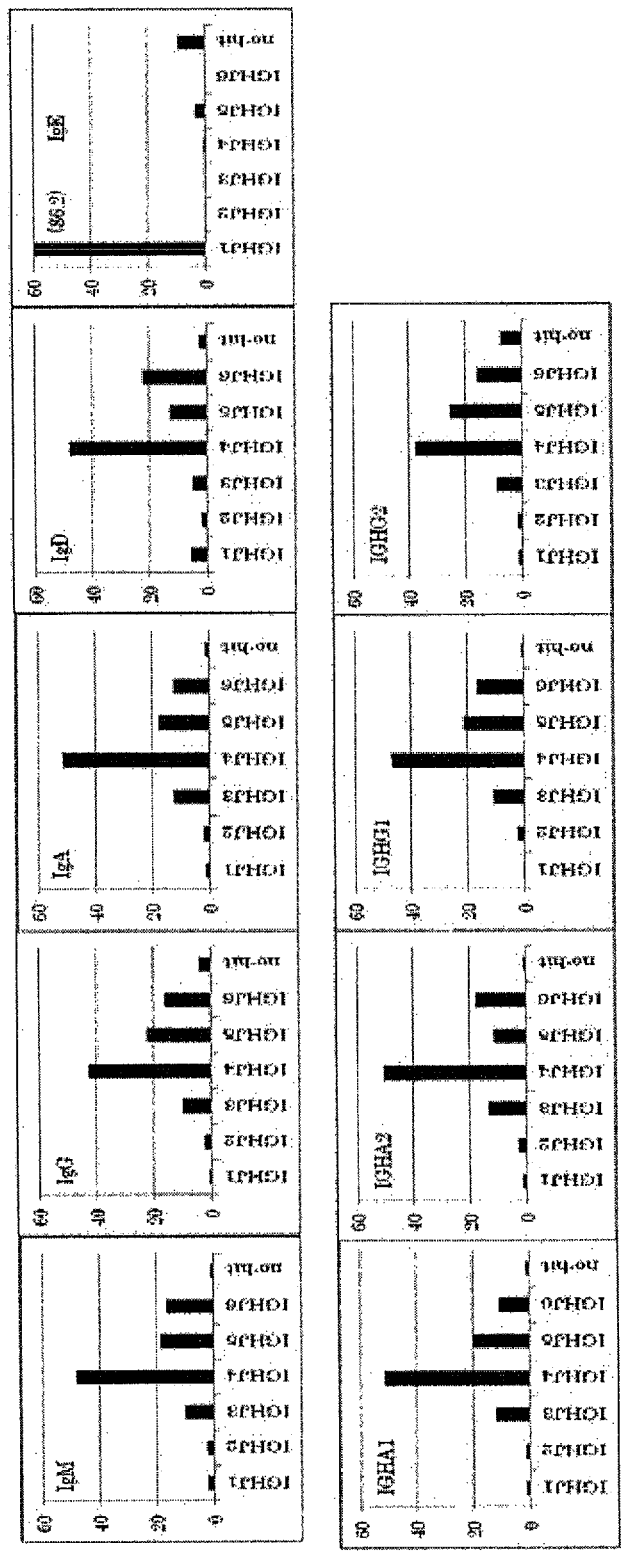
FIG. 9B shows results of analysis similar to FIG. 9A with an improved software. Similar results were also obtained with software (Repertoire genesis) that is pending together with this patent application. Furthermore, it was also possible to obtain a result of no hit.

FIG. 6 shows usage frequency of a C region sequence for each isotype. Search for homology with a C region sequence of immunoglobulin isotype including subclasses was performed on the obtained reads for each isotype. The frequency of number of reads for each subclass was 73% for IgA1 and 27% for IgA2 in the IgA subclass, 62% for IgG1 and 36% for IgG2 in the IgG subclass, while hardly any reads for IgG3 or IgG4 were obtained in the IgG subclass. Further, since obtained reads for each subclass were rarely classified into other classes, primer specificity was reconfirmed at the sequence level.

HighV-Quest of IMGT was used to assign V, D, and J regions (FIGS. 6A, 7A, 8A, and 9A). Further, the results of assignment of V, D, and J regions by using a newly developed repertoire analysis software (Repertoire Genesis, patent pending) are shown in Table 1-1H. The data for number of reads was used to find the frequency of a V region and J region (FIGS. 6B, 7B, 8B, and 9B). The data thereof is shown below (Table 1-1H).

TABLE 1-1H

| gene name | num reads | CDR3 amino acids | num reads | SEQ ID NO: |
|---|---|---|---|---|
| IgA | | | | |
| IGHD2-21 | 74 | CAKDMCGLWASCGGDCYSRRTTSLTT | 41 | 61 |
| | | CAKDMCGLWASCGGDCYSRRTASLTT | 5 | 62 |
| | | CARGPNMAFVVVTAILMLLIS | 4 | 63 |
| | | CARAPDCGGSTCYSHPYYGMDVW | 4 | 64 |
| | | CARSHIVVVTAIPLEMLLIS | 2 | 65 |
| | | CARDPRIVVVAPATHTPTTVWTS | 2 | 66 |
| IGHD6-13 | 41 | CGRSRHSSSWQILTP | 11 | 67 |
| | | CANGGLAAAGDHLTT | 5 | 68 |
| | | CALCPTPIAAAGSVTT | 5 | 69 |
| | | CARAPSIPVAGIGYHFDHW | 3 | 70 |
| | | CALCPNPYSSGWFCNYW | 3 | 71 |
| | | CARAPSIPVAGIATTLTT | 2 | 72 |
| IGHD3-3 | 37 | CIYDFWSGGPHPTLTT | 11 | 73 |
| | | CARIVNTEGFWSGFLTP | 4 | 74 |
| | | CTRRGGVVIICLTT | 2 | 75 |
| | | CIHTGNDFWTGTNYGLTS | 2 | 76 |
| | | CARIVNTEGFGVVFLTP | 2 | 77 |
| | | CAKDRFSGRGRFEFMEWLTPLTT | 2 | 78 |
| | | CAKDRFSEGKVQFMEWLTPLTT | 2 | 79 |
| IGHD3-22 | 36 | CARRPIPPLTMRVVVIPLTS | 5 | 80 |
| | | CARDPPMPMIVVQTLTT | 2 | 81 |
| | | CARDPPMPMILVQTLTT | 2 | 82 |
| | | CAKILITMILVVSLMLLIS | 2 | 83 |
| IGHD3-10 | 33 | CAREIRGTTMVRELTTSTATWTP | 6 | 84 |
| | | CVRTYYFGLGDIITEITSTVWTS | 3 | 85 |
| | | CATYYYGSGSAGHNFDYW | 2 | 86 |
| | | CARRTYYYGSTNLTT | 2 | 87 |
| | | CARMVTDYYGSGNRGWFDPW | 2 | 88 |
| | | CARGPGLSVMIRGVITTPNHILIT | 2 | 89 |
| | | CARDYYGSGVMTL | 2 | 90 |
| IGHD2-15 | 29 | CARAPDCGGGTCYSHPTTVWTS | 5 | 91 |
| | | CARARIVVVVPATLTPTTVWTS | 3 | 92 |
| | | CARAPDCGGGTCYSHPYYGMDVW | 3 | 93 |
| | | CAKDLAPLKSCSRGGCYPYYYGLDIW | 3 | 94 |
| IGHD1-26 | 22 | CARGPATAILGATPSLTP | 3 | 95 |
| | | CARDDSASYSRGTT | 3 | 96 |
| | | CVRHDYSDNDLSTNWFGP | 2 | 97 |
| IGHD5-5 | 19 | CMGPGDTAI | 7 | 98 |
| | | CARRPREMESAMVLSLTT | 2 | 99 |

TABLE 1-1H-continued

| gene name | num reads | CDR3 amino acids | num reads | SEQ ID NO: |
|---|---|---|---|---|
| IGHD3-9 | 19 | CAHSAPYYDILSRNRARSWKDFDNW | 3 | 100 |
| | | CAHSAPIMIFCLVTAHEVGRILTT | 3 | 101 |
| | | CATVALLRYFDWSSTR | 2 | 102 |
| IGHD6-19 | 14 | CARGRRSLPAIVYSSGPDRPNWFDPW | 6 | 103 |
| | | CTSAAVASSSGWPLRGVWTS | 3 | 104 |
| IGHD2-2 | 14 | CARAPLCSSASCHLQLDYW | 5 | 105 |
| IGHD4-23 | 11 | CARGAGYGGNSGVRTT | 9 | 106 |
| IGHD4-17 | 10 | CARTLYGDFVDF | 2 | 107 |
| IGHD3-16 | 9 | CAKGVLSSGGVIATLPGSTP | 3 | 108 |
| | | CARGFGARGVILT | 2 | 109 |
| IGHD2-8 | 8 | CANVGGADRNYCINGVRHNPNYLTT | 5 | 110 |
| IGHD6-6 | 5 | | | |
| IGHD5-12 | 5 | CARHVNGYDYLFPFTSW | 3 | 111 |
| IGHD1-1 | 3 | CARGGSQLERRRPLVTT | 3 | 112 |
| IGHD5-24 | 2 | | | |
| (unidentified) | 662 | CARETVGGTLTT | 19 | 113 |
| | | CARISSGHDPPIITGWTS | 13 | 114 |
| | | CAKGHQVRLRGRTGTSIS | 11 | 115 |
| | | CARSPIWFGSHRFTTTWRS | 9 | 116 |
| | | CARDPLETGATSLII | 9 | 117 |
| | | CAKLGNRPGFTEWDHWFGPW | 9 | 118 |
| | | CAGAPDCGVGAAPLTSTTVCTS | 8 | 119 |
| | | CVRDPHETGATTLIT | 6 | 120 |
| | | CARIRKEVGAPPITWTS | 6 | 121 |
| | | CARGSWSGAAFYSLTT | 6 | 122 |
| | | CARDPNKFRTNHLSTT | 6 | 123 |
| | | CAGIGGATSTTTTTWTS | 6 | 124 |
| | | CATVPELTDISLPRLMALIS | 5 | 125 |
| | | CARVWGKHTLTT | 5 | 126 |
| | | CARRAAPHDYGHVLIF | 5 | 127 |
| | | CARDPNKFRPNHLSSTT | 5 | 128 |
| | | CARAGRELLRALMTT | 5 | 129 |
| | | CARAGAELLRALMTT | 5 | 130 |
| | | CARAEDYYDTEGYFYLTP | 5 | 131 |
| | | CAHRTNYSTNRYGAITTLTS | 5 | 132 |
| | | CVRHDGSFTKTGSTP | 4 | 133 |
| | | CVRDPQETGATTLIT | 4 | 134 |
| | | CVKIGAAH | 4 | 135 |
| | | CATQCLGGAGLTTTTAPWTS | 4 | 136 |
| | | CARRTYYSGSTNLTT | 4 | 137 |
| | | CARRTTRETGSSIS | 4 | 138 |
| | | CARLRCSNDNCAGHLYYYFSGLDIW | 4 | 139 |
| | | CARASLPRGLLIS | 4 | 140 |
| | | CAKGRGRRAAGKFLTT | 4 | 141 |
| | | CVRQYGLGSGSLTP | 3 | 142 |
| | | CVKIRNLIGFTGSTP | 3 | 143 |
| | | CTRDGVRGDLNPTLNV | 3 | 144 |
| | | CTKGGGRKTAGKFLTP | 3 | 145 |
| | | CDKAKVTADLRT | 3 | 146 |
| | | CATVPELPDISLPRLMALIS | 3 | 147 |
| | | CATVFGRRYRLLTT | 3 | 148 |
| | | CARYRAAYPRRAWTS | 3 | 149 |
| | | CARTIGEEIAMTGGLGALTP | 3 | 150 |
| | | CARTARTGDL | 3 | 151 |
| | | CARRDPPVRASLSTTLTS | 3 | 152 |
| | | CARIGHEFYSLTYSVNDVFDLW | 3 | 153 |
| | | CARFQRCRGGSCSATLDAFDKW | 3 | 154 |
| | | CARDLGERRDGEPTNWFDAW | 3 | 155 |
| | | CARDLAVWATLTT | 3 | 156 |
| | | CAKGAGRRAAGKFLTT | 3 | 157 |
| | | CAKDVEPTVTLYNHFDP | 3 | 158 |
| | | CAKDFNWEGIT | 3 | 159 |
| | | CAHRTNYSTNRYGGLYYFDW | 3 | 160 |
| | | CVRGVGTILWLTI | 2 | 161 |
| | | CVRFIGAYSNNWYPGYFDYW | 2 | 162 |
| | | CVRDAGPGGSLTS | 2 | 163 |

TABLE 1-1H-continued

| gene name | num reads | CDR3 amino acids | num reads | SEQ ID NO: |
|---|---|---|---|---|
| | | CTTGFSGSTACHWDHTACHWDDAFAMW | 2 | 164 |
| | | CTHAVESLLGTTSTS | 2 | 165 |
| | | CIHTGNDFGPGPTMVWTS | 2 | 166 |
| | | CGVGRGDNDVDFKFKW | 2 | 167 |
| | | CATRESPLTT | 2 | 168 |
| | | CATAGIELWRAGSTP | 2 | 169 |
| | | CASQSQNYYYYYMDVW | 2 | 170 |
| | | CASKKEILWAGPNLTT | 2 | 171 |
| | | CARYRIAMATSPYFDYW | 2 | 172 |
| | | CARVRCGLVASEGVLIS | 2 | 173 |
| | | CARTNFGSGGYILGDTTMVWTS | 2 | 174 |
| | | CARSAGYLHRRTS | 2 | 175 |
| | | CARRTYYSGSTNFDYW | 2 | 176 |
| | | CARRDLPFGASLSTTLTS | 2 | 177 |
| | | CARRAAPMTTGMFLIF | 2 | 178 |
| | | CARPGFSYGPRLTP | 2 | 179 |
| | | CARLRGGFPPVVKRVEVFLLTS | 2 | 180 |
| | | CARKKIPTAGYSSLTT | 2 | 181 |
| | | CARGSWMGRPFISLTT | 2 | 182 |
| | | CARGRFARGGDDSLIS | 2 | 183 |
| | | CARGLRWADN | 2 | 184 |
| | | CARGGTSGLILDTTSTPWTS | 2 | 185 |
| | | CAREMHIDSLTVGRAFDIW | 2 | 186 |
| | | CARDVPDIYSSGATDC | 2 | 187 |
| | | CARDPSYLPTPALKT | 2 | 188 |
| | | CARDPNKFRPNHFVDYW | 2 | 189 |
| | | CARDLGTTNYWLDTW | 2 | 190 |
| | | CAKQRASGNSLTI | 2 | 191 |
| | | CAKEPKIVGRRRTTLIT | 2 | 192 |
| | | CAKDLGVCSEGAASSLVLIS | 2 | 193 |
| | | CAKAPGDLCRSTP | 2 | 194 |
| | | CAHSAPYYDICLVTAHEVGRILTT | 2 | 195 |
| | | CAGLIGRFIPLTT | 2 | 196 |
| | | CAGIRGSNIYYHYYYMDVW | 2 | 197 |
| | | CADLPGIIGGEIT | 2 | 198 |
| | IgD | | | |
| IGHD3-22 | 432 | CARHDTPRVYYDSSGYYYGVDYFDYW | 168 | 199 |
| | | CASMDTKNYYDSSGSQPRRSYYFDYW | 39 | 200 |
| | | CAQYYYDSSGYYYYYGMDVW | 25 | 201 |
| | | CARISYYYDSSGYYYRDW | 21 | 202 |
| | | CARVRGITMIVVVTTLTT | 17 | 203 |
| | | CASMDTKNYYDSSGSQPGGRTTLTT | 7 | 204 |
| | | CASMDTKITMIVVVPNPGGRTTLTT | 7 | 205 |
| | | CARYNYTIVVGP | 5 | 206 |
| | | CARISYYYDSSGYYTVT | 5 | 207 |
| | | CARIRYYYDSSGYYYFDYW | 4 | 208 |
| | | CARHVRDGMIVVAEIDYW | 4 | 209 |
| | | CARVAVRSYYPFGMDVW | 3 | 210 |
| | | CARLPLDSSGYYLTT | 3 | 211 |
| | | CARLPLDSSGYYFDYW | 3 | 212 |
| | | CASMDTKNYYDSSGSQPRRSHYFDYW | 2 | 213 |
| | | CARYRITMIVVVITTVT | 2 | 214 |
| | | CARYNYYDSSGSW | 2 | 215 |
| | | CARVRGYYDSMSMSALLMS | 2 | 216 |
| | | CARVRGTMIVVSMSALLMS | 2 | 217 |
| | | CARVRGNYYDSSGYYFDYW | 2 | 218 |
| | | CARSGRVGARPKLYYW | 2 | 219 |
| | | CARISYYYDVVVITTVT | 2 | 220 |
| | | CARHVRDGMIVVAEMTT | 2 | 221 |
| | | CARHDTPRAYYDSSGYYYGVDYFDYW | 2 | 222 |
| | | CAREFFGTRTMIVVVTYFDYW | 2 | 223 |
| | | CAQYYYDSMVITTTTVWTS | 2 | 224 |
| IGHD3-10 | 217 | CARGVRGVIINTFTTLTT | 118 | 225 |
| | | CTWFGEATTTVWTS | 25 | 226 |
| | | CARGGSGVIINTFTTLTT | 10 | 227 |
| | | CARCAGGSGSYYYYMEVW | 9 | 228 |
| | | CVKAGFGELLIGGDRIT | 6 | 229 |
| | | CARGGSGSYYKHVYYFDYW | 6 | 230 |
| | | CARCAGGSGVTTTTTWRS | 6 | 231 |

TABLE 1-1H-continued

| gene name | num reads | CDR3 amino acids | num reads | SEQ ID NO: |
|---|---|---|---|---|
| | | CTWFGGGYYYGMDVW | 5 | 232 |
| | | CTWFGGATTTVWTS | 3 | 233 |
| | | CARLDGSGRRGTALTT | 3 | 234 |
| | | CARLDVRGGRGTALTT | 2 | 235 |
| | | CARGGSGVIINTFTTLTM | 2 | 236 |
| | | CARCAGVRGVTTTTTWRS | 2 | 237 |
| IGHD3-16 | 169 | CARRVMITFGELSSTTLTT | 140 | 238 |
| | | CARRVMITFGGVIVTTLTM | 3 | 239 |
| | | CARRVMITFGGVIVDYFDYW | 3 | 240 |
| | | CARRVMITFGGVIVDTLTT | 3 | 241 |
| | | CANPTSFRQCSMTT | 3 | 242 |
| | | CARRVMITLGELSSTTLTT | 2 | 243 |
| | | CARRAMITFGELSSTTLTT | 2 | 244 |
| IGHD6-19 | 134 | CARHGIAVAYYFDYW | 28 | 245 |
| | | CARVSSGWSGGNPAPATLTT | 22 | 246 |
| | | CARHVGSGWVYFDYW | 12 | 247 |
| | | CARRDDSSGWYGHDYW | 11 | 248 |
| | | CARGYSSGFGDALIP | 8 | 249 |
| | | CARVSSGWSGVTPAPATLTT | 7 | 250 |
| | | CARRDDSMAGTAMTT | 4 | 251 |
| | | CARGYSSGFGDAFDTW | 4 | 252 |
| | | CARGIRYSSGWYGSNWFFDPW | 4 | 253 |
| | | CARRDDSSGWYGHDY | 3 | 254 |
| | | CARRDDSSAGTAMTT | 3 | 255 |
| | | CARHGLAWPTTLTT | 3 | 256 |
| | | CARHVGSGWVTLTT | 2 | 257 |
| | | CARHGIAVAVYLTT | 2 | 258 |
| IGHD5-5 | 122 | CARAGGYSYGYLLPLMLLIS | 29 | 259 |
| | | CARRKRELLWVTTTTTTWTS | 20 | 260 |
| | | CARQKSATVWTS | 17 | 261 |
| | | CARVNLEQLWYRRGTTTTVWTS | 8 | 262 |
| | | CARVNLEQLCTGRGTTTTVWTS | 7 | 263 |
| | | CARFYNRRMLSTAMVDIDYW | 5 | 264 |
| | | CARVNLEQLWYRTGYYYYGMDVW | 4 | 265 |
| | | CARLFNYAREYGMDVW | 4 | 266 |
| | | CARVNLEQLWYRTGSTTTVWTS | 2 | 267 |
| | | CARVAPRLTT | 2 | 268 |
| | | CARLFNYARGVRVWTS | 2 | 269 |
| IGHD1-26 | 85 | CARHVGSGWVYFDYW | 16 | 270 |
| | | CARAQYSGATECKGTLTT | 10 | 271 |
| | | CARHSLTPGFLLNYFDYW | 8 | 272 |
| | | CTRSRGLSGTYYNPDNDYW | 7 | 273 |
| | | CARAQYSGSYRMQRYFDYW | 7 | 274 |
| | | CARHVKVLGATVGFDYW | 3 | 275 |
| | | CARAQYSGSYRCKGTLTT | 3 | 276 |
| | | CTRSRGLSGTTTIQIMTT | 2 | 277 |
| | | CARPSIVGATECKGTLTT | 2 | 278 |
| | | CARHVAVAGSTLTT | 2 | 279 |
| | | CARAQYSGSYRMQRYLTT | 2 | 280 |
| | | CARAQYSGSYRMQGTLTT | 2 | 281 |
| | | CAHTHRSVGATA | 2 | 282 |
| IGHD6-13 | 73 | CAKVTHAYSSTWYHGDYYYYGMDVW | 28 | 283 |
| | | CARGHLPYSSTDKGHWFDPW | 16 | 284 |
| | | CARDSSHGYSSSWPDYW | 4 | 285 |
| | | CAKLPMRIAAPGTMGTTTTTVWTS | 3 | 286 |
| | | CARDSSTGIAAAGPTT | 2 | 287 |
| IGHD2-15 | 46 | CLASRPLWFGDPNGSTP | 5 | 288 |
| | | CAKDSSRYCSGGSCKYFDYW | 4 | 289 |
| | | CAKNPASTGYGSFDYW | 3 | 290 |
| | | CAKIRPVLVTEALTI | 3 | 291 |
| | | CAKDSSRYCMVVAANTLTT | 3 | 292 |
| | | CARLILGYCSGVGCTPT | 2 | 293 |
| | | CARDRGSGGSCYVLTT | 2 | 294 |
| | | CARDGVVVVLLLLTT | 2 | 295 |
| | | CANWARVVVASGTTTTWTS | 2 | 296 |
| | | CAKNPPVLVTEALTI | 2 | 297 |
| | | CAKNPAVLVTEALTI | 2 | 298 |
| IGHD3-3 | 25 | CASKKKFLEWPETTTTTVWTS | 6 | 299 |
| | | CARKEFLEWPETTTTTVWTS | 5 | 300 |
| | | CAKDINPDYDFWSGSHLPYDAFDIW | 5 | 301 |

TABLE 1-1H-continued

| gene name | num reads | CDR3 amino acids | num reads | SEQ ID NO: |
|---|---|---|---|---|
| | | CARKKNFLEWPETTTTTVWTS | 2 | 302 |
| | | CAKDINPDYDFWSGSHLPYDALIS | 2 | 303 |
| IGHD2-2 | 18 | CARDARYCSSTSCYSFPYWYFDLW | 2 | 304 |
| | | CARDARYCSSTSCYSFPTGTSIS | 2 | 305 |
| | | CARDARYCSSTSCYRFPYWYFDLW | 2 | 306 |
| IGHD5-12 | 15 | CARRLGRVATTYYMDVW | 5 | 307 |
| | | CARRLVEWLRPTTWTS | 3 | 308 |
| | | CARRVGVEWLRPTTWTS | 2 | 309 |
| IGHD2-8 | 13 | CTRDIVLTTPREWYFDLW | 5 | 310 |
| | | CTRDIVLTTPGSGTSIS | 3 | 311 |
| IGHD4-17 | 5 | CARDLIYGDYPTTTWTS | 4 | 312 |
| (unidentified) | 989 | CARGAAPGVETGSTP | 264 | 313 |
| | | CARHTLFSDSSAPPRGVYYYYYMDVW | 60 | 314 |
| | | CARGATVGVETGSTP | 52 | 315 |
| | | CANWAGVTGTVPLTT | 41 | 316 |
| | | CARQKSATVWTS | 33 | 317 |
| | | CARAGIQLEVFTLTT | 21 | 318 |
| | | CARLDGSGGRGTALTT | 20 | 319 |
| | | CARRKRELLWVTTTTTTWTS | 19 | 320 |
| | | CANPDLISAMFDDYW | 14 | 321 |
| | | CARHQCSGEACPYYYGMDVW | 13 | 322 |
| | | CANPTSFRQCSMTT | 12 | 323 |
| | | CARGGTIPFPWTS | 9 | 324 |
| | | CARAQGGAHTTLTT | 9 | 325 |
| | | CTRDTGSSAGATDLW | 8 | 326 |
| | | CAKAVAVTGSHFDYW | 8 | 327 |
| | | CARGAAPGVETGSTL | 7 | 328 |
| | | CARAQGRGTYYFDYW | 7 | 329 |
| | | CARAIIRYFND | 7 | 330 |
| | | CAIPPDGSRRSPLTT | 7 | 331 |
| | | CVREGFCGAHGCYSLTYW | 6 | 332 |
| | | CARHTLFSDSSAPPRGSTTTTTWTS | 6 | 333 |
| | | CARGYSSASVMLLIP | 6 | 334 |
| | | CVREGFVVLMAVILLPT | 5 | 335 |
| | | CARSGPRGLTT | 5 | 336 |
| | | CARHSLTPGFLLNYFDYW | 5 | 337 |
| | | CARGWELDRW | 5 | 338 |
| | | CARDPSSLYYYYYGMDVW | 5 | 339 |
| | | CARAHHISMT | 5 | 340 |
| | | CANPDSFRQCSMTT | 5 | 341 |
| | | CAIPRTEGRRSPLTT | 5 | 342 |
| | | CARTFGDSAALIS | 4 | 343 |
| | | CARLFNYAREYGMDVW | 4 | 344 |
| | | CARHTLFSDSSAPPTGGLLLLLHGRL | 4 | 345 |
| | | CARHTLFRIVVPLPGGSTTTTTWTS | 4 | 346 |
| | | CARDLGESSSTTLTT | 4 | 347 |
| | | CARAIIRYFNDW | 4 | 348 |
| | | CAPGGLRLGVETGSTP | 4 | 349 |
| | | CARTLDYGIATGSIIMVWTS | 3 | 350 |
| | | CARRLGRVARPTTWTS | 3 | 351 |
| | | CARLFNTPGSTVWTS | 3 | 352 |
| | | CAIPPTEGRRSPLTT | 3 | 353 |
| | | CAIPPDGRQTVPFDYW | 3 | 354 |
| | | CTRDTGSPPEPLTS | 2 | 355 |
| | | CATSRGGRGTT | 2 | 356 |
| | | CATSGGVGDY | 2 | 357 |
| | | CATPTSFRQCSMTT | 2 | 358 |
| | | CATAAGLWSSSTTWTS | 2 | 359 |
| | | CATAAGLWSSKYYMDVW | 2 | 360 |
| | | CASKKSATVWTS | 2 | 361 |
| | | CARVGSSTMLLIS | 2 | 362 |
| | | CARVGSSPMLLIS | 2 | 363 |
| | | CARVAARPMLLIS | 2 | 364 |
| | | CARTFVIRLLLIS | 2 | 365 |
| | | CARRLGRVLRPTTWTS | 2 | 366 |
| | | CARRKKGSCYRVTTTTTTWTS | 2 | 367 |
| | | CARLFNYARSTVWTS | 2 | 368 |
| | | CARHVGMAGSTLTT | 2 | 369 |
| | | CARHTLFSDSSAPPRGGLLLLLHGRL | 2 | 370 |
| | | CARHTLFSDSSALPRGVYYYYYMDVW | 2 | 371 |
| | | CARHTLFSDSSALPGGSTTTTTWTS | 2 | 372 |
| | | CARHQCSGEACFYYTAWTS | 2 | 373 |

TABLE 1-1H-continued

| gene name | num reads | CDR3 amino acids | num reads | SEQ ID NO: |
|---|---|---|---|---|
| | | CARGYSMASVMLLIP | 2 | 374 |
| | | CARGWELDR | 2 | 375 |
| | | CARGQMGATTLIDYW | 2 | 376 |
| | | CAREWPTGTRGMW | 2 | 377 |
| | | CAREWPTGTRGMC | 2 | 378 |
| | | CAREWPTGNQRGCG | 2 | 379 |
| | | CARDSTQTT | 2 | 380 |
| | | CARAQYGGATECKGTLTT | 2 | 381 |
| | | CARAQGAGAHTTLTT | 2 | 382 |
| | | CARAKYDISMT | 2 | 383 |
| | | CARAIYDISMT | 2 | 384 |
| | | CARAHRYSMT | 2 | 385 |
| | | CARAHGAGAHTTLTT | 2 | 386 |
| | | CANWPGVTGTVPLTT | 2 | 387 |
| | | CAKRWGSSSWTT | 2 | 388 |
| | | CAKIRPVLVTEALTI | 2 | 389 |
| | | CAKDLHSYGYLGAFDIW | 2 | 390 |
| | | CAIPPDGRQTSPLTT | 2 | 391 |
| | | CAIPPDGRQTAPLTT | 2 | 392 |
| | | CAHTHRSVGALP | 2 | 393 |
| | | CAGVAPRLTT | 2 | 394 |
| | | IgE | | |
| IGHD4-17 | 3475 | CARGFDGGWEHW | 3103 | 395 |
| | | CARGFLMVAGEHW | 113 | 396 |
| | | CARGFLMVAGST | 25 | 397 |
| | | CARGFDGGWGAL | 21 | 398 |
| | | CARGFDGGWEH | 17 | 399 |
| | | CARGFDGAGST | 12 | 400 |
| | | CARGFDGGWEYW | 10 | 401 |
| | | CARGFDGGWEHR | 10 | 402 |
| | | CAGGFDGGWEHW | 9 | 403 |
| | | CARGLMVAGST | 8 | 404 |
| | | CARGFDGGWST | 8 | 405 |
| | | CARGFDGGREHW | 8 | 406 |
| | | CVRGFDGGWEHW | 7 | 407 |
| | | CARGLDGGWEHW | 7 | 408 |
| | | CARGFDGGWGHW | 7 | 409 |
| | | CARGFDGGWGALG | 6 | 410 |
| | | CARGFDGAGEHW | 6 | 411 |
| | | CARGSDGGWEHW | 5 | 412 |
| | | CARGFGGWEHW | 5 | 413 |
| | | CARGFDGSWEHW | 5 | 414 |
| | | CARGFDGGWERW | 5 | 415 |
| | | CARGFDDGWEHW | 5 | 416 |
| | | YARGFDGGWEHW | 4 | 417 |
| | | CARGFDGGWKHW | 4 | 418 |
| | | CARGFDGGSGAL | 4 | 419 |
| | | CARGFVWWLGGT | 3 | 420 |
| | | CARGFDSGWEHW | 3 | 421 |
| | | CARGFDRWLGAL | 3 | 422 |
| | | CARGFDGGWVHW | 3 | 423 |
| | | CARGFDGGWEAL | 3 | 424 |
| | | CARGFDGDWEHW | 3 | 425 |
| | | CARGFDGAGSM | 3 | 426 |
| | | CARSFDGGWEHW | 2 | 427 |
| | | CARGFLMVAGEHG | 2 | 428 |
| | | CARGFLMVAGEH | 2 | 429 |
| | | CARGFDVAGST | 2 | 430 |
| | | CARGFDGGWEHS | 2 | 431 |
| | | CARGFDGGWEHG | 2 | 432 |
| | | CARGFDGGCEHW | 2 | 433 |
| | | CARGFDGAGEH | 2 | 434 |
| IGHD1-7 | 3 | CARGFDGGWEHW | 3 | 435 |
| (unidentified) | 166 | CARGFDGGWEHW | 124 | 436 |
| | | CARGFLMVAGEHW | 14 | 437 |
| | | CARGFDGGWEHS | 5 | 438 |
| | | CARGFLMVAGST | 4 | 439 |
| | | CARGFVWWLGGT | 2 | 440 |
| | | CARGFLMVAGSTG | 2 | 441 |
| | | CARGFDGGSGAL | 2 | 442 |
| | | CARGFDGAGST | 2 | 443 |

TABLE 1-1H-continued

| gene name | num reads | CDR3 amino acids | num reads | SEQ ID NO: |
|---|---|---|---|---|
| | | IgG | | |
| IGHD3-10 | 60 | CARGRYAGGVIITALTP | 13 | 444 |
| | | CARLPRMVRGNWFHP | 8 | 445 |
| | | CARGAWAVRGVISWAGSTP | 6 | 446 |
| | | CSREVGRDYYGSGVIEITWTS | 4 | 447 |
| | | CAGSGSGSLLTTVWTP | 4 | 448 |
| | | CSREVGRDYYGSGSYRNYMDVW | 3 | 449 |
| | | CVSITNSLLWFGELLIFDCW | 2 | 450 |
| IGHD3-22 | 59 | CAKITSMIVVLIPTMMLLMS | 20 | 451 |
| | | CARGSRARFSSDTSGYQYFDYW | 4 | 452 |
| | | CARGVYLYYDSHAYSVLTT | 3 | 453 |
| | | CARVNYYDSVVLTT | 2 | 454 |
| | | CARVNYYDSSRIDYW | 2 | 455 |
| | | CARLPPFNNDDSSSYALYLTT | 2 | 456 |
| | | CARHSNYYDTSGYRVLDAFDIW | 2 | 457 |
| | | CARGGMDSYGYFYVGHYDYW | 2 | 458 |
| | | CARDPDF | 2 | 459 |
| | | CAKITSMIVVLTPTMMLLMS | 2 | 460 |
| IGHD6-13 | 34 | CTRQEESSAAGTGGTSSP | 7 | 461 |
| | | CALCPTPIAAAGSVTT | 7 | 462 |
| | | CATSEGDPVAAAGTKSWFDSW | 3 | 463 |
| | | CARLALLYGSSRYGATLTT | 2 | 464 |
| | | CARGPSSTWYSFDYW | 2 | 465 |
| IGHD2-15 | 31 | CAKKEFILVVVITMMSLLMS | 6 | 466 |
| | | CAKDMTAKACSDYW | 3 | 467 |
| | | CARVMGCRGGRCDFRAFDIW | 2 | 468 |
| | | CARRFCSGGICYFLTT | 2 | 469 |
| | | CALTGLNGRSCYSELLIS | 2 | 470 |
| | | CAKEGVYFSGGNHYDVAFNVW | 2 | 471 |
| IGHD3-3 | 28 | CARPSRCCYSGGGRLTL | 4 | 472 |
| | | CAHSVGFILDFWSGYQNNWFDPW | 4 | 473 |
| | | CARPSRCCYVRGGRLTL | 2 | 474 |
| | | CAMGPTIFGVVFLGSLTS | 2 | 475 |
| | | CAHSVGFILDFWSGYQNNWFDPG | 2 | 476 |
| | | CAHSVGFILDFGVVIRTTGSTP | 2 | 477 |
| IGHD6-25 | 21 | CARVKGGIAGMAWTS | 19 | 478 |
| IGHD5-5 | 21 | CARGVDTTMVRSTTLTT | 7 | 479 |
| | | CARQDPYCSTSNCTMGGAMTLTT | 5 | 480 |
| IGHD5-24 | 21 | CARTDGIRDGYNLHRVLTT | 2 | 481 |
| | | CARTDAIRDGYNLHRVFDYW | 2 | 482 |
| | | CARGKRDAYNYYSHLDSW | 2 | 483 |
| | | CARGKEMPITTLILTP | 2 | 484 |
| IGHD3-16 | 19 | CVRQSPLDDVWGVFAPVGSTP | 11 | 485 |
| | | CVRQSPLDDVWGVFAPVGSTL | 2 | 486 |
| IGHD4-17 | 14 | CARHPKPPTVTSATT | 2 | 487 |
| | | CAKGENTVTTGQEYW | 2 | 488 |
| | | CAKGENTVTTGQEY | 2 | 489 |
| IGHD3-9 | 12 | CAREGRNYDSLTGDPWFDPW | 2 | 490 |
| IGHD2-2 | 12 | CASRYCTSDRCLGASGKPSFDTW | 2 | 491 |
| | | CARHSLAYCSTTSCAVFDYW | 2 | 492 |
| | | CARHGFEGREVVPPAMNEYYYYYMDVW | 2 | 493 |
| IGHD1-7 | 11 | CARGDCTTINCNTHSDYYGLDVW | 3 | 494 |
| | | CARTVGTGTTNGYLTS | 2 | 495 |
| | | CAREIVLLSTATLTPTTTVWTS | 2 | 496 |
| IGHD5-12 | 10 | CARDSGYDYGYYHNGMDVW | 2 | 497 |
| IGHD4-23 | 9 | CARGAGYGGNSGVRTT | 6 | 498 |
| IGHD2-21 | 9 | | | |
| IGHD6-19 | 8 | CARDLGSGWFRFDP | 2 | 499 |
| | | CARDLGSGWFGSTP | 2 | 500 |

TABLE 1-1H-continued

| gene name | num reads | CDR3 amino acids | num reads | SEQ ID NO: |
|---|---|---|---|---|
| IGHD2-8 | 7 | CAKSHHCTNGVCHPPRFGQRSTP | 2 | 501 |
| IGHD1-26 | 6 | | | |
| IGHD1-20 | 2 | | | |
| (unidentified) | 773 | CARGATVGVETGSTP | 32 | 502 |
| | | CARKGSRHGGSTP | 28 | 503 |
| | | CARQNGPSIGGGSTP | 23 | 504 |
| | | CARGATPGAETGSTP | 23 | 505 |
| | | CAKDTLGGMGGLTS | 13 | 506 |
| | | CARVRVLPEGVLISLRPLGSTTITWTS | 11 | 507 |
| | | CARGGPKKVVTAAHLSP | 11 | 508 |
| | | CSTLGLGPPPGGQTT | 10 | 509 |
| | | CARDHYDTRGVRMLLIS | 10 | 510 |
| | | CATDRDSSWGTSLTT | 9 | 511 |
| | | CARMVRGGGRTSSGYYYYYMDVW | 9 | 512 |
| | | CARDGVWDLPTTLTT | 9 | 513 |
| | | CVRMGPPCQLAGRSSSLTS | 6 | 514 |
| | | CTMATVGHGLRRCFGKSTATLTS | 6 | 515 |
| | | CARRGGSTVTTGTSIS | 6 | 516 |
| | | CSTLGLGPPGGLTT | 5 | 517 |
| | | CMGPGETAI | 5 | 518 |
| | | CARVSMIRFRVWGLWTS | 5 | 519 |
| | | CARVQRGAVVIPTT | 5 | 520 |
| | | CARRRYNDLGAPNWVDPW | 5 | 521 |
| | | CARGEDCGGGRCNNLPTTVWTS | 5 | 522 |
| | | CAKRKLAPPRKFTTLTT | 5 | 523 |
| | | CATLEGGAPPDLRRAEAFLLIS | 4 | 524 |
| | | CARQDPYCSTSNCTMGGAMTLTT | 4 | 525 |
| | | CARGKDCGGGRCNNVPYYGMDVW | 4 | 526 |
| | | CAKDGHKLTGTTTRTS | 4 | 527 |
| | | CAILPETQWYPRLTT | 4 | 528 |
| | | CVRDLGAITPVFSTS | 3 | 529 |
| | | CVHRPRWLNVVPT | 3 | 530 |
| | | CVHRPRWLNVVPN | 3 | 531 |
| | | CARSFVVKVHAHCGAVLSST | 3 | 532 |
| | | CARRLNVAVVVPAYVGWFDPW | 3 | 533 |
| | | CARLGKNHSQGVDYW | 3 | 534 |
| | | CARGPGGVWDRLSLTS | 3 | 535 |
| | | CARGKDCGGGRCNNVPTTGWTS | 3 | 536 |
| | | CARGFMVQASSVRLKRGQFLADSW | 3 | 537 |
| | | CARGDWGTVTLATT | 3 | 538 |
| | | CARDWEWQQRLNYFDP | 3 | 539 |
| | | CARDNQPWRDARNLGGAFDVW | 3 | 540 |
| | | CARDGLRPPPFMVTIQRGGLTT | 3 | 541 |
| | | CARAVGGFNSGWPSIGVPARSTP | 3 | 542 |
| | | CARAVGGFNSGWPSIGVPARSTL | 3 | 543 |
| | | CAKVDETVVLPAALLTP | 3 | 544 |
| | | CAKSPKPWSQLVSTPIMPTPWTS | 3 | 545 |
| | | CVRRAAGGRSGLTT | 2 | 546 |
| | | CVRPPPTVPGTAGSTP | 2 | 547 |
| | | CVRESTFYYFGPW | 2 | 548 |
| | | CVRDDDYSRTWYMGQGASSDYGMDVW | 2 | 549 |
| | | CVKWVSGVLTSLTT | 2 | 550 |
| | | CVALFVPAGSTL | 2 | 551 |
| | | CTMATVGHGATTLFREVHRNTDFW | 2 | 552 |
| | | CSTLGLGPRGADYW | 2 | 553 |
| | | CSRTGGRLLIS | 2 | 554 |
| | | CSKVGRILKLIT | 2 | 555 |
| | | CKVAVEMVLMY | 2 | 556 |
| | | CGKFLGTTVASS | 2 | 557 |
| | | CATSGRSSAWYPDVFDIW | 2 | 558 |
| | | CATNYCRGISCYPAPLTT | 2 | 559 |
| | | CATLTGGAPPDLRRAEAFLLIS | 2 | 560 |
| | | CATEGTGAVTPFTT | 2 | 561 |
| | | CATAPGGTSYT | 2 | 562 |
| | | CASRPSWGSSFDFW | 2 | 563 |
| | | CASRPPGAAALTS | 2 | 564 |
| | | CASMIALHHTLTS | 2 | 565 |
| | | CARYSPVDPSTLDFW | 2 | 566 |
| | | CARVLDSSAHWYFDDW | 2 | 567 |
| | | CARRRYNDLGAPTGSTP | 2 | 568 |
| | | CARQNGPSIGGGSTL | 2 | 569 |
| | | CARQHSEWRILRLVFDHW | 2 | 570 |
| | | CARMVREEAERRPAIIITTWTS | 2 | 571 |

TABLE 1-1H-continued

| gene name | num reads | CDR3 amino acids | num reads | SEQ ID NO: |
|---|---|---|---|---|
| | | CARLPRMVRVTGSTP | 2 | 572 |
| | | CARIDYVSTWYYDQW | 2 | 573 |
| | | CARICAEREFLSLLTP | 2 | 574 |
| | | CARGPGWGMGSTKFDCW | 2 | 575 |
| | | CARGGKSATGANYHQFFDCW | 2 | 576 |
| | | CARGDCTTINCNTHSTTTVWTS | 2 | 577 |
| | | CARGATVGVETGSTL | 2 | 578 |
| | | CARGATLGVETGWTP | 2 | 579 |
| | | CAREYYGILGYYFDYW | 2 | 580 |
| | | CARDWEWQQRLNYFDPW | 2 | 581 |
| | | CARDNQPWRDARNLGVHLMC | 2 | 582 |
| | | CARDHYYDERNQGPDW | 2 | 583 |
| | | CARDGGLAGTGTLEY | 2 | 584 |
| | | CARAGLVLGPYGMDIW | 2 | 585 |
| | | CARAGGHGTWTS | 2 | 586 |
| | | CAKVAETLVSTGFDSYYAYSMDVW | 2 | 587 |
| | | CAKTYDYGSRGFSILLIS | 2 | 588 |
| | | CAKSLRVGGDVFETW | 2 | 589 |
| | | CAKSDYFDP | 2 | 590 |
| | | CAKGRGRLVTIATTLTT | 2 | 591 |
| | | CAKGAGRRAAGKFLTT | 2 | 592 |
| | | CAKAKRRSLGMQTLPTLRGRSDGFDVW | 2 | 593 |
| | | CAKAHFPGDLPSFSSIS | 2 | 594 |
| | | CAKADCGTGCFIVDDW | 2 | 595 |
| | | CAHQQWRPGRRGFDYW | 2 | 596 |
| | | IgM | | |
| IGHD6-13 | 148 | CARTYSSWYRGPLSP | 24 | 597 |
| | | CTRQEESSAAGTGGTSSP | 16 | 598 |
| | | CARPIAAAGSRGFGTLTT | 15 | 599 |
| | | CAQRRPSSSTWYAPTLTT | 7 | 600 |
| | | CAQRRPNSSTWYAPTLTT | 4 | 601 |
| | | CARDLGGYSSSWSTNYYYYMDVW | 3 | 602 |
| | | CAKVNWGIAAAGSYAFDIW | 3 | 603 |
| | | CAHRVRGMTSSSWYYGTFDYW | 3 | 604 |
| | | CVRPGATAGTLLTV | 2 | 605 |
| | | CARTYSSWYRGGPLSP | 2 | 606 |
| | | CARPQRYSSSWYDDYYYGMDVW | 2 | 607 |
| | | CARPIAAAGSRGVRYFDYW | 2 | 608 |
| | | CARGVLAPLYSSTLKLRFSVWTS | 2 | 609 |
| | | CARGLVAAAGTRRGWFTP | 2 | 610 |
| | | CARGLVAAAGTRRGWFDPW | 2 | 611 |
| | | CARDSGQIVAAVTLDYW | 2 | 612 |
| | | CARAPSIPVAGIGYHFDHW | 2 | 613 |
| | | CAQRRPNSSTWYRPLTTT | 2 | 614 |
| | | CAKVNWGYSSCWFLRFLIS | 2 | 615 |
| | | CAKEGVPIAAPGLTT | 2 | 616 |
| | | CAHSRAAAGSLTT | 2 | 617 |
| | | CAHSRAAAGSFDYW | 2 | 618 |
| | | CAHRVRGNDKQQLVLWGPLTT | 2 | 619 |
| | | CAHRVRGMTSSSWYYGTLTT | 2 | 620 |
| IGHD2-15 | 123 | CARVEGGLTT | 15 | 621 |
| | | CAKGWTAARGALNTSST | 14 | 622 |
| | | CARFWSGVGLTT | 7 | 623 |
| | | CAREVYLYCNGGRCYWRGSSP | 5 | 624 |
| | | CARSEYCRGGNCYFNGYYFDSW | 3 | 625 |
| | | CARAPYCSGGSCYLFDYW | 3 | 626 |
| | | CARGFVVVTATLGTTITPWTS | 2 | 627 |
| | | CARDLCGGSCSRIIGSTP | 2 | 628 |
| | | CARAGYCSGGSCYGWFDPW | 2 | 629 |
| | | CAKTKTGTTKINTTLTT | 2 | 630 |
| | | CAKNGILTGWVNGYTTLTT | 2 | 631 |
| | | CAKGQTTAILGSTDFNWFDPW | 2 | 632 |
| | | CAKFHLQPSLLMVRRSPTS | 2 | 633 |
| IGHD3-22 | 117 | CARDPRGAVGITTGPTH | 9 | 634 |
| | | CARGSPPGAVGFIGSTP | 8 | 635 |
| | | CAKDMGGITMIVVVMISLTT | 6 | 636 |
| | | CARARRGHGSTTTWTS | 5 | 637 |
| | | CARDPPRMLLIS | 4 | 638 |
| | | CARDLSYYDSSGYYAYW | 4 | 639 |
| | | CATYKYYDSSGFMTT | 3 | 640 |
| | | CATYKYYDSSGFHDYW | 3 | 641 |
| | | CARDLSYYDSSGYYAYV | 3 | 642 |
| | | CAHRRPYYYDSSGYYYAFDYW | 3 | 643 |

TABLE 1-1H-continued

| gene name | num reads | CDR3 amino acids | num reads | SEQ ID NO: |
|---|---|---|---|---|
| | | CLTMIVPT | 2 | 644 |
| | | CATVTGGSSGYYYHVYYFDYW | 2 | 645 |
| | | CARVRYSGGILGLPLTT | 2 | 646 |
| | | CARGRRGIVVVTPKEVRFDYW | 2 | 647 |
| | | CARGIWVSTGYYRYYFDNW | 2 | 648 |
| | | CAREGYDSGGYYYEVEAFDIW | 2 | 649 |
| | | CARDAGPITTTVAGHMRLLTF | 2 | 650 |
| | | CAHRRPITMVVVTTMPLTT | 2 | 651 |
| IGHD5-5 | 89 | CARGGGKDLLASYLTT | 19 | 652 |
| | | CTSRGYSYGAPRWD | 7 | 653 |
| | | CARRWGRGRDTAMNLTTTTVWTS | 7 | 654 |
| | | CSRGGPGTAMVST | 3 | 655 |
| | | CARRGGGGDTAMNLTTTTVWTS | 3 | 656 |
| | | CARHGDSFVQPRRTT | 3 | 657 |
| | | CAKHDGQSNTLTA | 3 | 658 |
| | | CATNTAMGFNEAVLIS | 2 | 659 |
| | | CARRGYSSMGIWDLST | 2 | 660 |
| | | CARRGGRGRDTAMNLTTTTVWTS | 2 | 661 |
| | | CARQGSRLFHYYYYMDVW | 2 | 662 |
| | | CARHKPGYSYVFLTT | 2 | 663 |
| IGHD3-10 | 78 | CGREGAGSAPWTS | 5 | 664 |
| | | CARHRITMVRELSYTTTWTS | 5 | 665 |
| | | CARDSDQQHGVRGVIPMAVWTS | 5 | 666 |
| | | CATTPLMTLVRGLTTTWTS | 4 | 667 |
| | | CARHQVSMVRGVTRSTGSTP | 4 | 668 |
| | | CARDEWFGESEVTNLDAFDIW | 3 | 669 |
| | | CAHSEGRITMVRGVIGPFDYW | 3 | 670 |
| | | CARGQTYGSGPRGFDPW | 2 | 671 |
| | | CARGLYGSGSYYIKRRKTGSTP | 3 | 672 |
| | | CARAMVRGVLALTT | 2 | 673 |
| | | CAKVGVGSMTMDRGVMTT | 2 | 674 |
| IGHD3-3 | 77 | CARDPPFGVVISTVWTS | 14 | 675 |
| | | CARDRGRVLRFCPQGVPSLTT | 8 | 676 |
| | | CASQTVVDFGVVIILLTTLTT | 5 | 677 |
| | | CASLDFGVVIILTS | 4 | 678 |
| | | CARHRSTTILEWFVNHETGSTP | 4 | 679 |
| | | CAQSHYDFGVVHLIPGSTP | 4 | 680 |
| | | CARGSPHYDFGVEIRTGSTP | 3 | 681 |
| | | CARDPLWSGYFYGMDVW | 3 | 682 |
| | | CARVGTYDFGVVMSNS | 2 | 683 |
| | | CARHRSITIPGVVRKSRNWFDPW | 2 | 684 |
| | | CARDRFSLNSAFGVVEGSYWFDPW | 2 | 685 |
| | | CAQSHYDFWSGYYSNTGFDPW | 2 | 686 |
| IGHD1-20 | 51 | CASVGGTRGPGDPGLGT | 12 | 687 |
| | | CAKGGFIVGATLTT | 4 | 688 |
| | | CAKFGGRIVGATMTT | 3 | 689 |
| | | CARVRYSGRYSRSTVDYW | 2 | 690 |
| | | CARLKCGLTTCLHKTLIS | 2 | 691 |
| | | CARDSVGATTTDYW | 2 | 692 |
| IGHD6-19 | 50 | CAHPGSGWPLTTLTT | 6 | 693 |
| | | CARGGSVAGTGSSTP | 4 | 694 |
| | | CARARITVAAPYDYW | 4 | 695 |
| | | CARLISSGWYLTT | 3 | 696 |
| | | CARTSLEQQLVFMTENSSGWSFDYW | 2 | 697 |
| | | CARGGIAVAGTRIKTTT | 2 | 698 |
| | | CARDQQWLPDYY | 2 | 699 |
| | | CARARITVAAPYDY | 2 | 700 |
| | | CARARITVAAPMTT | 2 | 701 |
| | | CAKGVGSGWYDFFDYW | 2 | 702 |
| | | CAKGPRFQWLAPYWYFDLW | 2 | 703 |
| IGHD3-9 | 39 | CARGGSLVLDVLTT | 17 | 704 |
| | | CARGGSLMLDVLTT | 10 | 705 |
| | | CASGPYFDWLLTYMDVW | 2 | 706 |
| | | CARGPLYDILTGPTPTTTTWTS | 2 | 707 |
| | | CARGGSIVLDVLTT | 2 | 708 |
| IGHD2-8 | 30 | CAKWGGNSSWKS | 7 | 709 |
| | | CARRSWCTNGVGYYISVALVTGSTP | 6 | 710 |
| | | CARGSRYCTNGVCYFWFDPW | 3 | 711 |
| | | CARDVLGYCTSTACWRGGPNHYYYGMDVW | 3 | 712 |

TABLE 1-1H-continued

| gene name | num reads | CDR3 amino acids | num reads | SEQ ID NO: |
|---|---|---|---|---|
| IGHD5-24 | 38 | CARGIEMATILLTT | 16 | 713 |
| | | CARGSRWLQFFDYW | 3 | 714 |
| | | CARGGERWLQSGATTLTT | 2 | 715 |
| IGHD6-6 | 22 | CTRGLVIEDIAARPGGA | 2 | 716 |
| | | CASDRGVQLVQDYYFGMDVW | 2 | 717 |
| IGHD5-12 | 21 | CARNARGGVATIFRGSTP | 8 | 718 |
| | | CARIQVATIDPKPKRLPSVWTS | 2 | 719 |
| IGHD4-17 | 19 | CARDWNGDYDYYYYGMDVW | 6 | 720 |
| | | CARDWNGDYTTTTTVWTS | 2 | 721 |
| IGHD2-2 | 16 | CARDRSSTSCCHFDYL | 2 | 722 |
| IGHD2-21 | 13 | CARGPAYCGSDCYSYFQHW | 2 | 723 |
| IGHD4-23 | 9 | CARGGDYGGTPLTT | 6 | 724 |
| IGHD1-7 | 6 | CARDGPPRITGTTEVTT | 3 | 725 |
| IGHD1-1 | 6 | CARRVGASGTSIS | 4 | 726 |
| IGHD3-16 | 4 | CARAHYDYVWGSYRSPPTT | 2 | 727 |
| IGHD1-20 | 4 | | | |
| IGHD4-4 | 3 | CARPVTTGTHRGYFDLW | 2 | 728 |
| (unidentified) | 834 | CASVGGTRVPGDPGLGT | 35 | 729 |
| | | CAHLTITFGEFSERMLSTS | 29 | 730 |
| | | CARLGYYDRRTT | 27 | 731 |
| | | CAGEVYIWNSMTT | 18 | 732 |
| | | CARGARGDNSTMT | 15 | 733 |
| | | CARGGSRWPRTTLTT | 13 | 734 |
| | | CARMGGPPTGTSIS | 12 | 735 |
| | | CVRGGLYTIPT | 11 | 736 |
| | | CARGGCGNYCPTTTSWTS | 11 | 737 |
| | | CARRDSSRGTTLTT | 10 | 738 |
| | | CARTTGTTTTTTWTS | 8 | 739 |
| | | CARISRYSNSPPSLTT | 8 | 740 |
| | | CARHLGVRGPWALFIS | 7 | 741 |
| | | CARDPPRMLLIS | 7 | 742 |
| | | CAKGDIVTT | 7 | 743 |
| | | CARGGGVSSRRITSTP | 6 | 744 |
| | | CAREGVRSLTT | 6 | 745 |
| | | CAKDKTYDTHGYSPF | 6 | 746 |
| | | CASLLLPTVTGGVLLIS | 5 | 747 |
| | | CARDYGATGSLDC | 5 | 748 |
| | | CARDFGSGGVLTWPS | 5 | 749 |
| | | CARYPGIEVTGTGALTT | 4 | 750 |
| | | CARRGDVGNYCPTTTSWTS | 4 | 751 |
| | | CARLPGITTTTTWTS | 4 | 752 |
| | | CARHVKPVDGNAYYEDSV | 4 | 753 |
| | | CARGTRGISEPTKFDYW | 4 | 754 |
| | | CARGGPERQLDDS | 4 | 755 |
| | | CAHRRPDSSTWYAPTLTT | 4 | 756 |
| | | CVSRRQTTPTSTVGPS | 3 | 757 |
| | | CVRKEVMYFDP | 3 | 758 |
| | | CGDTLGETMPVTA | 3 | 759 |
| | | CATRRGQFWTT | 3 | 760 |
| | | CARVVGGGVTTTTTVWTS | 3 | 761 |
| | | CARVLLSGSTWYAEYFQSW | 3 | 762 |
| | | CARTLSATGDNWFGPW | 3 | 763 |
| | | CARTGARGDNSTMTS | 3 | 764 |
| | | CARQTPGTLQTTTTTTVWTS | 3 | 765 |
| | | CARPRYDYGLLLIS | 3 | 766 |
| | | CARLTRRTTVVPRTSTT | 3 | 767 |
| | | CARHVKPVDGNAYYEDSW | 3 | 768 |
| | | CARHRGVRGPWALFIS | 3 | 769 |
| | | CARGSPPGAVGFIGSTP | 3 | 770 |
| | | CARLSSSRSLSSTP | 3 | 771 |
| | | CARGGATPGG | 3 | 772 |
| | | CAREVPTGPRTSTTVWTS | 3 | 773 |
| | | CARDPRADYLAFDIW | 3 | 774 |
| | | CANGDTARPTGTLAT | 3 | 775 |
| | | CAKAPSDTIIVHGPQHLTT | 3 | 776 |

TABLE 1-1H-continued

| gene name | num reads | CDR3 amino acids | num reads | SEQ ID NO: |
|---|---|---|---|---|
| | | CAARGRTTLTT | 3 | 777 |
| | | CVRGSGRTGEAT | 2 | 778 |
| | | CVREARTPATTYGWYYYDYW | 2 | 779 |
| | | CVRDNSWSSRDAERYYYNMDVW | 2 | 780 |
| | | CVRDLAWRTQQLSENWFDPW | 2 | 781 |
| | | CVRDLAWRTQQLLSEIGSTV | 2 | 782 |
| | | CVRDLAWRTEQLLSENWFDPW | 2 | 783 |
| | | CVRDLAWRTEELLSENWFDTW | 2 | 784 |
| | | CVRDLAWRTEELLSENWFDTW | 2 | 785 |
| | | CVRDLAWRTEELLSEIGSTL | 2 | 786 |
| | | CVHRPRWLNIVANV | 2 | 787 |
| | | CTWWQQLGEFLTS | 2 | 788 |
| | | CTSLTSMVNFMLLMS | 2 | 789 |
| | | CTRQEESSAAGTGGTSSP | 2 | 790 |
| | | CTRDGVRGDLNPTLNV | 2 | 791 |
| | | CMRHQHQRPRTT | 2 | 792 |
| | | CITDCTGGSCDFAGPGEYW | 2 | 793 |
| | | CATYYYKLVVIDTLTT | 2 | 794 |
| | | CATGAATVLLTT | 2 | 795 |
| | | CASRPGHHSGPLTT | 2 | 796 |
| | | CASRPGHHSGPFDYW | 2 | 797 |
| | | CASPVGGGET | 2 | 798 |
| | | CARWPPIQGELLIS | 2 | 799 |
| | | CARVRSGLLPTTTTTWTS | 2 | 800 |
| | | CARVQLIGDSGVRPWTT | 2 | 801 |
| | | CARVLRGPTTLTT | 2 | 802 |
| | | CARQWGIRGVALTT | 2 | 803 |
| | | CARPRYDLRFCLLIS | 2 | 804 |
| | | CARNTEATTT | 2 | 805 |
| | | CARMPGKEIAMADLATLTT | 2 | 806 |
| | | CARLTRRTTVGTPDIDYV | 2 | 807 |
| | | CARHVKPVDGNSYYEDS | 2 | 808 |
| | | CARHLVW | 2 | 809 |
| | | CARHDPVPQFKHGWTS | 2 | 810 |
| | | CARGGPGRQLTMT | 2 | 811 |
| | | CARGGGKDLLASYLTT | 2 | 812 |
| | | CARGARSGSSMTA | 2 | 813 |
| | | CARDYGATGSLDCW | 2 | 814 |
| | | CARDVIGAAASYVAFDIW | 2 | 815 |
| | | CARDEWFGSPKSRTLMLLIS | 2 | 816 |
| | | CARAQNWDLLTGTSIS | 2 | 817 |
| | | CARAPSIPVAVSATTLTT | 2 | 818 |
| | | CAKHDGQSNIPDCW | 2 | 819 |
| | | CAKGWTAARGALNTSST | 2 | 820 |
| | | CAKGPPVVTTLDTSST | 2 | 821 |
| | | CAKDRGGS | 2 | 822 |
| IGHA1 | | | | |
| IGHD3-22 | 35 | CARRPIPPLTMRVVVIPLTS | 5 | 823 |
| | | CARDPPMPMIVVQTLTT | 2 | 824 |
| | | CARDPPMPMILVQTLTT | 2 | 825 |
| | | CAKILITMILVVSLMLLIS | 2 | 826 |
| IGHD6-13 | 27 | CGRSRHSSSWQILTP | 11 | 827 |
| | | CANGGLAAAGDHLTT | 5 | 828 |
| | | CARAPSIPVAGIGYHFDHW | 3 | 829 |
| | | CARAPSIPVAGIATTLTT | 2 | 830 |
| IGHD3-10 | 26 | CAREIRGTTMVRELTTSTATWTP | 6 | 831 |
| | | CVRTYYFGLGDIITEITSTVWTS | 3 | 832 |
| | | CARRTYYYGSTNLTT | 2 | 833 |
| | | CARMVTDYYGSGNRGWFDPW | 2 | 834 |
| | | CARDYYGSGVMTL | 2 | 835 |
| IGHD5-5 | 19 | CMGPGDTAI | 7 | 836 |
| | | CARRPREMESAMVLSLTT | 2 | 837 |
| IGHD3-9 | 19 | CAHSAPYYDILSRNRARSWKDFDNW | 3 | 838 |
| | | CAHSAPIMIFCLVTAHEVGRILTT | 3 | 839 |
| | | CATVALLRYFDWSSTR | 2 | 840 |
| IGHD3-3 | 17 | CTRRGGVVIICLTT | 2 | 841 |
| | | CIHTGNDFWTGTNYGLTS | 2 | 842 |
| | | CAKDRFSGRGRFEFMEWLTPLTT | 2 | 843 |
| | | CAKDRFSEGKVQFMEWLTPLTT | 2 | 844 |

TABLE 1-1H-continued

| gene name | num reads | CDR3 amino acids | num reads | SEQ ID NO: |
|---|---|---|---|---|
| IGHD6-19 | 14 | CARGRRSLPAIVYSSGPDRPNWFDPW | 6 | 845 |
| | | CTSAAVASSSGWPLRGVWTS | 3 | 846 |
| IGHD2-2 | 14 | CARAPLCSSASCHLQLDYW | 5 | 847 |
| IGHD1-26 | 13 | CARDDSASYSRGTT | 3 | 848 |
| IGHD2-21 | 12 | CARSHIVVTAIPLEMLLIS | 2 | 849 |
| IGHD4-23 | 11 | CARGAGYGGNSGVRTT | 9 | 850 |
| IGHD2-15 | 11 | CAKDLAPLKSCSRGGCYPYYYGLDIW | 3 | 851 |
| IGHD4-17 | 9 | CARTLYGDFVDF | 2 | 852 |
| IGHD6-6 | 5 | | | |
| IGHD5-12 | 4 | CARHVNGYDYLFPFTSW | 3 | 853 |
| IGHD3-16 | 4 | CAKGVLSSGGVIATLPGSTP | 3 | 854 |
| IGHD1-1 | 3 | CARGGSQLERRRPLVTT | 3 | 855 |
| IGHD5-24 | 2 | | | |
| IGHD2-8 | 2 | | | |
| (unidentified) | 531 | CARETVGGTLTT | 19 | 856 |
| | | CARISSGHDPPIITGWTS | 13 | 857 |
| | | CARSPIWFGSHRFTTTWRS | 9 | 858 |
| | | CARDPLETGATSLII | 9 | 859 |
| | | CAKLGNRPGFTEWDHWFGPW | 9 | 860 |
| | | CVRDPHETGATTLIT | 6 | 861 |
| | | CARIRKEVGAPPITWTS | 6 | 862 |
| | | CARGSWSGAAFYSLTT | 6 | 863 |
| | | CARDPNKFRTNHLSTT | 6 | 864 |
| | | CATVPELTDISLPRLMALIS | 5 | 865 |
| | | CARVWGKHTLTT | 5 | 866 |
| | | CARDPNKFRPNHLSTT | 5 | 867 |
| | | CARAGRELLRALMTT | 5 | 868 |
| | | CARAGAELLRALMTT | 5 | 869 |
| | | CARAEDYYDTEDYFYLTP | 5 | 870 |
| | | CAHRTNYSTNRYGAFTTLTS | 5 | 871 |
| | | CVRDPQETGATTLIT | 4 | 872 |
| | | CATQCLGGAGLTTTTAPWTS | 4 | 873 |
| | | CARRTYYSGSTNLTT | 4 | 874 |
| | | CARRTTRETGSSIS | 4 | 875 |
| | | CVRQYGLGSGSLTP | 3 | 876 |
| | | CVKIRNLIGFTGSTP | 3 | 877 |
| | | CTRDGVRGDLNPTLNV | 3 | 878 |
| | | CDKAKVTADLRT | 3 | 879 |
| | | CATVPELPDISLPRLMALIS | 3 | 880 |
| | | CATVFGRRYRLLTT | 3 | 881 |
| | | CARYRAAYPRRAWTS | 3 | 882 |
| | | CARTIGFEIAMTGGLGALTP | 3 | 883 |
| | | CARRDPPVRASLSTTLTS | 3 | 884 |
| | | CARFQRYCRGGSCSATLDAFDKW | 3 | 885 |
| | | CARDLGERRDGEPTNWFDAW | 3 | 886 |
| | | CARDLAVWATLTT | 3 | 887 |
| | | CAKDVEPTVTLYNHFDP | 3 | 888 |
| | | CAKDFNWEGIT | 3 | 889 |
| | | CAHRTNYSTNRYGGLYYFDFW | 3 | 890 |
| | | CVRGVGTILWLTI | 2 | 891 |
| | | CVRDAGPGGSLTS | 2 | 892 |
| | | CTTGFSGSTACHWDHTACHWDDAFAMW | 2 | 893 |
| | | CTHAVESLLGTTSTS | 2 | 894 |
| | | CIHTGNDFGPGPTMVWTS | 2 | 895 |
| | | CGVGRGDNDVDFKFKW | 2 | 896 |
| | | CATRESPLTT | 2 | 897 |
| | | CATAGIELWRAGSTP | 2 | 898 |
| | | CARYRIAMATSPYFDVW | 2 | 899 |
| | | CARTNFGSGGYILGDTTMVWTS | 2 | 900 |
| | | CARSAGYLHRRTS | 2 | 901 |
| | | CARRTYYSGSTNFDYW | 2 | 902 |
| | | CARRDLPFGASLSTTLTS | 2 | 903 |
| | | CARPGFSYGPRLTP | 2 | 904 |
| | | CARKKIPTAGYSSLTT | 2 | 905 |

TABLE 1-1H-continued

| gene name | num reads | CDR3 amino acids | num reads | SEQ ID NO: |
|---|---|---|---|---|
| | | CARGSWMGRPFISLTT | 2 | 906 |
| | | CARGLRWADN | 2 | 907 |
| | | CARGGTSGLILDTTSTPWTS | 2 | 908 |
| | | CAREMHIDSLTVGRAFDIW | 2 | 909 |
| | | CARDVPDIYSSGATDC | 2 | 910 |
| | | CARDPSYLPTPALKT | 2 | 911 |
| | | CARDPNKFRPNHFVDYW | 2 | 912 |
| | | CARDLGTTNYWLDTW | 2 | 913 |
| | | CAKQRASGNSLTI | 2 | 914 |
| | | CAKEPKIVGRRRTTLIT | 2 | 915 |
| | | CAKDLGVCSEGAASSLVLIS | 2 | 916 |
| | | CAHSAPYYDICLVTAHEVGRILTT | 2 | 917 |
| | | CAGLIGRFIPLTT | 2 | 918 |
| | | IGHA2 | | |
| IGHD2-21 | 62 | CAKDMCGLWASCGGDCYSRRTTSLTT | 41 | 919 |
| | | CAKDMCGLWASCGGDCYSRRTASLTT | 5 | 920 |
| | | CARGPNMAFVVVTAILMLLIS | 4 | 921 |
| | | CARAPDCGGSTCYSHPYYGMDVW | 4 | 922 |
| | | CARDPRIVVVAPATHTPTTVWTS | 2 | 923 |
| IGHD3-3 | 20 | CIYDFWSGGPHPTLTT | 11 | 924 |
| | | CARIVNTEGFWSGFLTP | 4 | 925 |
| | | CARIVNTEGFGVVFLTP | 2 | 926 |
| IGHD2-15 | 18 | CARAPDCGGTCYSHPTTVWTS | 5 | 927 |
| | | CARARIVVVPATLTPTTVWTS | 3 | 928 |
| | | CARAPDCGGTCYSHPYYGMDVW | 3 | 929 |
| IGHD6-13 | 14 | CALCPTPIAAAGSVTT | 5 | 930 |
| | | CALCPNPYSSGWFCNYW | 3 | 931 |
| IGHD1-26 | 9 | CARGPATAILGATPSLTP | 3 | 932 |
| | | CVRHDYSDNDLSTNWFGP | 2 | 933 |
| IGHD3-10 | 7 | CATYYYGSGSAGHNFDYW | 2 | 934 |
| | | CARGPGLSVMIRGVITTPNHILIT | 2 | 935 |
| IGHD2-8 | 6 | CANVGGADRNYCINGVRHNPNYLTT | 5 | 936 |
| IGHD3-16 | 5 | CARGFGARGVILT | 2 | 937 |
| IGHD5-12 | 1 | CVLSRGLVATRTLDYW | 1 | 938 |
| IGHD4-17 | 1 | CARTLYGDFVDSL | 2 | 939 |
| IGHD3-22 | 1 | CARDKQESSGSPRNYYFDYW | 1 | 940 |
| (unidentified) | 131 | CAKGHQVRLRGRTGTSIS | 11 | 941 |
| | | CAGAPDCGVGAAPLTSTTVCTS | 8 | 942 |
| | | CAGIGGATSTTTTTWTS | 6 | 943 |
| | | CARRAAPHDYGHVLIF | 5 | 944 |
| | | CVRHDGSFTKTGSTP | 4 | 945 |
| | | CVKIGAAH | 4 | 946 |
| | | CARLRCSNDNCAGHLYYYFSGLDIW | 4 | 947 |
| | | CARASLPRGLLIS | 4 | 948 |
| | | CTKGGGRKTAGKFLTP | 3 | 949 |
| | | CARTARTGDL | 3 | 950 |
| | | CARIGHEFYSLTYSVNDVFDLW | 3 | 951 |
| | | CAKGRGRRAAGKFLTT | 3 | 952 |
| | | CAKGAGRRAAGKFLTT | 3 | 953 |
| | | CVRFIGAYSNNWYPGYFDYW | 2 | 954 |
| | | CASQSQNYYYYYMDVW | 2 | 955 |
| | | CASKKEILWAGPNLTT | 2 | 956 |
| | | CARVRCGLVASEGVLIS | 2 | 957 |
| | | CARRAAPMTTGMFLIF | 2 | 958 |
| | | CARLRGGFPPVVKRVEVFLLTS | 2 | 959 |
| | | CARGRFARGGDDSLIS | 2 | 960 |
| | | CAKAPGDLCRSTP | 2 | 961 |
| | | CAGIRGSNIYYHYYYMDVW | 2 | 962 |
| | | CADLPGIIGGEIT | 2 | 963 |
| | | IGHG1 | | |
| IGHD3-22 | 52 | CAKITSMIVVLIPTMMLLMS | 20 | 964 |
| | | CARGSRARFSSDTSGYQYFDYW | 4 | 965 |

TABLE 1-1H-continued

| gene name | num reads | CDR3 amino acids | num reads | SEQ ID NO: |
|---|---|---|---|---|
| | | CARGVYLYYDSHAYSVLTT | 3 | 966 |
| | | CARVNYYDSVVLTT | 2 | 967 |
| | | CARVNYYDSSRIDYW | 2 | 968 |
| | | CARLPPFNNDDSSSYALYLTT | 2 | 969 |
| | | CARHSNYYYDTSGYRVLDAFDIW | 2 | 970 |
| | | CARGGMDSYGYFYVGHYDYW | 2 | 971 |
| | | CAKITSMIVVLTPTMMLLMS | 2 | 972 |
| IGHD3-10 | 35 | CARLPRMVRGNWFHP | 8 | 973 |
| | | CARGAWAVRGVISWAGSTP | 6 | 974 |
| | | CAGSGSGSLLTTVWTP | 4 | 975 |
| | | CVSITNSLLWFGELLIFDCW | 2 | 976 |
| IGHD6-13 | 31 | CTRQEESSAAGTGGTSSP | 7 | 977 |
| | | CALCPTPIAAAGSVTT | 7 | 978 |
| | | CATSEGDPVAAAGTKSWFDSW | 3 | 979 |
| | | CARLALLYGSSRYGATLTT | 2 | 980 |
| | | CARGPSSTWYSFDYW | 2 | 981 |
| IGHD3-3 | 20 | CAHSVGFILDFWSGYQNNWFDPW | 4 | 982 |
| | | CAMGPTIFGVVFLGSLTS | 2 | 983 |
| | | CAHSVGFILDFWSGYQNNWFDPG | 2 | 984 |
| | | CAHSVGFILDFGVVIRTTGSTP | 2 | 985 |
| IGHD3-16 | 19 | CVRQSPLDDVWGVFAPVGSTP | 11 | 986 |
| | | CVRQSPLDDVWGVFAPVGSTL | 2 | 987 |
| IGHD5-5 | 18 | CARGVDTTMVRSTTLTT | 7 | 988 |
| | | CARQDPYCSTSNCTMGGAMTLTT | 5 | 989 |
| IGHD5-24 | 14 | CARTDGIRDGYNLHRVLTT | 2 | 990 |
| | | CARTDAIRDGYNLHRVFDYW | 2 | 991 |
| IGHD3-9 | 11 | CAREGRNYDSLTGDPWFDPW | 2 | 992 |
| IGHD1-7 | 11 | CARGDCTTINCNTHSDYYGLDVW | 3 | 993 |
| | | CARTVGTGTTNGYLTS | 2 | 994 |
| | | CAREIVLLSTATLTPTTTVWTS | 2 | 995 |
| IGHD4-17 | 10 | CARHPKPPTVTSATT | 2 | 996 |
| IGHD5-12 | 9 | CARQDSGYDYGYYHNGMDVW | 2 | 997 |
| IGHD2-2 | 9 | CARHSLAYCSTTSCAVFDYW | 2 | 998 |
| | | CARHGFEGREVVPPAMNEYYYYYMDVW | 2 | 999 |
| IGHD2-15 | 9 | CALTGLNGRSCYSELLIS | 2 | 1000 |
| IGHD4-23 | 7 | CARGAGYGGNSGVRTT | 6 | 1001 |
| IGHD1-26 | 5 | | | |
| IGHD2-21 | 4 | | | |
| IGHD2-8 | 3 | | | |
| (unidentified) | 444 | CARGATVGVETGSTP | 32 | 1002 |
| | | CARKGSRHGGSTP | 28 | 1003 |
| | | CARQNGPSIGGGSTP | 23 | 1004 |
| | | CARGATPGAETGSTP | 23 | 1005 |
| | | CAKDTLGGMGGLTS | 13 | 1006 |
| | | CARVRVLPEGVLISLRPLGSTTITWTS | 11 | 1007 |
| | | CATDRDSSWGTSLTT | 9 | 1008 |
| | | CARRGGSTVTTGTSIS | 6 | 1009 |
| | | CARQDPYCSTSNCTMGGAMTLTT | 4 | 1010 |
| | | CAILPETQWYPRLTT | 4 | 1011 |
| | | CVHRPRWLNVVPT | 3 | 1012 |
| | | CVHRPRWLNVVPN | 3 | 1013 |
| | | CARLGKNHSQGVDYW | 3 | 1014 |
| | | CARGFMVQASSVRLKRGQFLADSW | 3 | 1015 |
| | | CARGDWGTVTLATT | 3 | 1016 |
| | | CARDNQPWRDARNLGGAFDVW | 3 | 1017 |
| | | CARDGLRPPPFMVTIQRGGLTT | 3 | 1018 |
| | | CARAVGGFNSGWPSIGVPARSTP | 3 | 1019 |
| | | CARAVGGFNSGWPSIGVPARSTL | 3 | 1020 |
| | | CAKSPKPWSQLVSTPIMPTPWTS | 2 | 1021 |
| | | CVRESTFYYFGPW | 2 | 1022 |

TABLE 1-1H-continued

| gene name | num reads | CDR3 amino acids | num reads | SEQ ID NO: |
|---|---|---|---|---|
| | | CVRDDDYSRTWYGQGASSDYGMDVW | 2 | 1023 |
| | | CVKWVSGVLTSLTT | 2 | 1024 |
| | | CATSGRSSAWYPDVFDIW | 2 | 1025 |
| | | CATNYCRGISCYPAPLTT | 2 | 1026 |
| | | CASMIALHHTLTS | 2 | 1027 |
| | | CARYSPVDPSTLDFW | 2 | 1028 |
| | | CARVLDSSAHWYFDDW | 2 | 1029 |
| | | CARQNGPSIGGGSTL | 2 | 1030 |
| | | CARQHSEWEILRLVEDHW | 2 | 1031 |
| | | CARLPRMVRVTGSTP | 2 | 1032 |
| | | CARIDYVSTWYYDQW | 2 | 1033 |
| | | CARICAEREFLSLLTP | 2 | 1034 |
| | | CARGDCTTINCNTHSTTTVWTS | 2 | 1035 |
| | | CARGATVGVETGSTL | 2 | 1036 |
| | | CARGATLGVETGWTP | 2 | 1037 |
| | | CAREYYGILYGYYFDYW | 2 | 1038 |
| | | CARDNQPWRDARNLGVHLMC | 2 | 1039 |
| | | CARDGGLAGTGTLEY | 2 | 1040 |
| | | CARAGLVLGPYGMDIW | 2 | 1041 |
| | | CAKVAETLVSTGFDSYYAYSMDVW | 2 | 1042 |
| | | CAKTYDYGSRGFSILLIS | 2 | 1043 |
| | | CAKGAGRRAAGKFLTT | 2 | 1044 |
| | | CAKAKRRSLGMQTLPTLRGRSDGFDVW | 2 | 1045 |
| | | CAKADCGTGCFIVDDW | 2 | 1046 |
| IGHG2 | | | | |
| IGHD3-10 | 24 | CARGRYAGGVIITALTP | 13 | 1047 |
| | | CSREVGRDYYGSGVIEITWTS | 4 | 1048 |
| | | CSREVGRDYYGSGSYRNYMDVW | 3 | 1049 |
| IGHD2-15 | 22 | CAKKEFILVVVITMMSLLMS | 6 | 1050 |
| | | CAKDMTAKACSDYW | 3 | 1051 |
| | | CARVMGCRGGRCDPRAFDIW | 2 | 1052 |
| | | CARRFCSGGICYFLTT | 2 | 1053 |
| | | CAKEGVYFSGGNHYDVAFNVW | 2 | 1054 |
| IGHD6-25 | 21 | CARVKGGIAGMAWTS | 19 | 1055 |
| IGHD6-19 | 8 | CARDLGSGWFRFDP | 2 | 1056 |
| | | CARDLGSGWFGSTP | 2 | 1057 |
| IGHD3-3 | 8 | CARPSRCCYSGGGRLTL | 4 | 1058 |
| | | CARPSRCCYVRGGRLTL | 2 | 1059 |
| IGHD5-24 | 7 | CARGKRDAYNYYSHLDSW | 2 | 1060 |
| | | CARGKEMPTITTLILTP | 2 | 1061 |
| IGHD4-17 | 4 | CAKGENTVTTGQEYW | 2 | 1062 |
| | | CAKGENTVTTGQEY | 2 | 1063 |
| IGHD3-22 | 4 | CARDPDF | 2 | 1064 |
| IGHD2-8 | 4 | CAKSHHCTNGVCHPPRFGQRSTP | 2 | 1065 |
| IGHD6-13 | 3 | | | |
| IGHD5-5 | 3 | | | |
| IGHD2-21 | 3 | | | |
| IGHD2-2 | 3 | CASRYCTSDRCLGASGKPSFDTW | 2 | 1066 |
| IGHD4-23 | 2 | | | |
| IGHD1-20 | 2 | | | |
| (unidentified) | 317 | CARGGPKKVVTAAHLSP | 11 | 1067 |
| | | CSTLGLGPPGGQTT | 10 | 1068 |
| | | CARDHYDTRGVRMLLIS | 10 | 1069 |
| | | CARMVRGGGRTSSGYYYYYMDVW | 9 | 1070 |
| | | CARDGVWDLPTTLTT | 9 | 1071 |
| | | CTMATVGHGLRRCFGKSTATLTS | 6 | 1072 |
| | | CVRMGPPCQLAGRSSSLTS | 5 | 1073 |
| | | CSTLGLGPPGGLTT | 5 | 1074 |
| | | CMGPGETAI | 5 | 1075 |
| | | CARVSMIRFRVWGLWTS | 5 | 1076 |

TABLE 1-1H-continued

| gene name | num reads | CDR3 amino acids | num reads | SEQ ID NO: |
|---|---|---|---|---|
| | | CARVQRGAVVIPTT | 5 | 1077 |
| | | CARRRYNDLGAPNWVDPW | 5 | 1078 |
| | | CARGEDCGGGRCNNLPTTVWTS | 5 | 1079 |
| | | CAKRKLAPPRKFTTLTT | 5 | 1080 |
| | | CATLEGGAPPDLRRAEAFLLIS | 4 | 1081 |
| | | CARGKDCGGGRCNNVPYYGMDVW | 4 | 1082 |
| | | CAKDGHKLTGTTTRTS | 4 | 1083 |
| | | CVRDLGAITPVFSTS | 3 | 1084 |
| | | CARSFVVKVHAHCGAVLSST | 3 | 1085 |
| | | CARRLNVAVVVPAYVGWFDPW | 3 | 1086 |
| | | CARGKDCGGGRCNNVPTTGWTS | 3 | 1087 |
| | | CARDWEWQQRLNYFDP | 3 | 1088 |
| | | CVRRAAGGRSGLTT | 2 | 1089 |
| | | CVRPPPTVPGTAGSTP | 2 | 1090 |
| | | CVALFVPAGSTL | 2 | 1091 |
| | | CTMATVGHGATTLFREVHRNTDFW | 2 | 1092 |
| | | CSTLGLGPRGADYW | 2 | 1093 |
| | | CSRTGGRLLIS | 2 | 1094 |
| | | CSKVGRILKLIT | 2 | 1095 |
| | | CKVAVEMVLMY | 2 | 1096 |
| | | CGKFLGTTVASS | 2 | 1097 |
| | | CATLTGGAPPDLRRAEAFLLIS | 2 | 1098 |
| | | CATEGTGAVTPFTT | 2 | 1099 |
| | | CATAPGGTSYT | 2 | 1100 |
| | | CASRPSWGSSFDFW | 2 | 1101 |
| | | CASRPPGAAALTS | 2 | 1102 |
| | | CARRRYNDLGAPTGSTP | 2 | 1103 |
| | | CARMVREEAERRPAIIITTWTS | 2 | 1104 |
| | | CARGPGWGMGSTKFDCW | 2 | 1105 |
| | | CARGPGGVWDRLSLTS | 2 | 1106 |
| | | CARGGKSATGANYHQFFDCW | 2 | 1107 |
| | | CARDWEWQQRLNYFDPW | 2 | 1108 |
| | | CARDHYYDERNQGPDW | 2 | 1109 |
| | | CARAGGHGTWTS | 2 | 1110 |
| | | CAKSLRVGGDVFEIW | 2 | 1111 |
| | | CAKSDYFDP | 2 | 1112 |
| | | CAKGRGRLVTIATTLTT | 2 | 1113 |
| | | CAKAHFPGDLPSFSSIS | 2 | 1114 |
| | | CAHQQWRPGRRGFDYW | 2 | 1115 |

FIG. 7 (A-D) show a V region repertoire for each isotype. A repertoire of a V region sequence for each isotype (BCR V repertoire) is shown. BCR V repertoires were very similar among IgM, IgG, IgA, and IgD, but only a read having IGHV3-30 was obtained for IgE. A reason therefor is suggested to be the possibility that there are much fewer number of IgE positive cells in peripheral blood relative to other classes and therefore a biased repertoire was detected.

FIG. 8 (A-D) show a V region repertoire for each subtype. A BCR V repertoire is shown for each IgA and IgG subclass. The IgA subclass had different frequencies in several types of V chains between IgA1 and IgA2. The frequency of presence of IGHV1-18 and IGHV4-39 was higher in IgA1 compared to that in IgA2, while the frequency of presence of IGHV3-23 and IGHV3-74 was higher in IgA2 than that in IgA1. For the IgG subclass, the frequency of IGHV3-23 and IGHV3-74, which were found to be increased in IgA2, was higher in IgG2 compared to that in IgG1. There were few reads for IgG3 and IgG4 (10 reads). The frequency of clones with IGHV4-59-1GHJ4-IGHD1-7 was 3/10 in IgG3, thus having high clonality. Reads with IGHV3-23-IGHJ4-IGHD3-10 accounted for 5/10 for IgG4 (Table 1-3).

TABLE 1-3

| CDR3 amino acid sequence of BCR read | | | | |
|---|---|---|---|---|
| V | J | D | AA JUNCTION | frequency |
| IgG3 | | | | |
| IGHV4-59 | IGHJ4 | IGHD1-7 | CARVVGNWNYEWIFDNW (SEQ ID NO: 20) | 3/10 |
| IGHV3-30-3 | IGHJ3 | IGHD5-12 | CARMYRRVYGFDAW (SEQ ID NO: 21) | 2/10 |
| IGHV1-18 | IGHJ4 | IGHD2-21 | CARRHYGDRGYYFDIW (SEQ ID NO: 22) | 1/10 |
| IGHV1-2 | IGHJ3 | IGHD6-13 | CVRDRLPSWAAAGKDSFGLW (SEQ ID NO: 23) | 1/10 |
| IGHV4-34 | IGHJ6 | IGHD3-10 | CARGRKLPVRGVRGMFYYYGVDVW (SEQ ID NO: 24) | 1/10 |

TABLE 1-3-continued

CDR3 amino acid sequence of BCR read

| V | J | D | AA JUNCTION | frequency |
|---|---|---|---|---|
| IGHV4-39 | IGHJ6 | IGHD6-19 | CARQIVRNSGWYVAWYNYYLLDLW (SEQ ID NO: 25) | 1/10 |
| IGHV4-59 | IGHJ3 | IGHD3-22 | CARQSLYRIYYSDSSGYRLDAFDIW (SEQ ID NO: 26) | 1/10 |
| IgG4 | | | | |
| IGHV3-23 | IGHJ4 | IGHD3-10 | CAKYLMILGHFDIW (SEQ ID NO: 27) | 5/10 |
| IGHV2-70 | IGHJ4 | IGHD6-13 | CARLLGSGWYHFDKW (SEQ ID NO: 28) | 2/10 |
| IGHV1-69 | IGHJ4 | IGHD5-24 | CARGRPSRDGYRPPMYYFLDYW (SEQ ID NO: 29) | 1/10 |
| IGHV3-21 | IGHJ3 | IGHD2-2 | CARGCSANCPTVAFDLW (SEQ ID NO: 30) | 1/10 |
| IGHV3-23 | IGHJ5 | IGHD6-19 | CAKDRGNSGWWSWLDPW (SEQ ID NO: 31) | 1/10 |

FIG. 9 shows a BCRJ repertoire for each subclass.

IGHJ4 was used in about half of the reads in IgM, IgG, IgA and IgD, while IGHJ2 was hardly used. Only IGHJ1 was used in IgE. An IGHJ repertoire in subclasses of IgM and IgA was also studied. A significant difference among subclasses was not observed unlike an IGHV repertoire.

The above results demonstrated that unbiased quantitative analysis is possible with the sample providing method of the present invention.

Preparation Example 2

Analysis of TCR Repertoire in Peripheral Blood of Healthy Individuals

The present Example performed TCR repertoire analysis on peripheral blood of healthy individuals.
(Materials and Methods)
(Sample)
Peripheral blood mononuclear cells of 10 healthy individuals
(Method)
(1. RNA Extraction)
5 mL of whole blood was collected from 10 healthy individuals in a heparin-containing blood collection tube. Peripheral blood mononuclear cells (PBMC) were separated by ficoll density gradient centrifugation. Total RNA was extracted/purified from the isolated PBMCs by using an RNeasy Lipid Tissue Mini Kit (Qiagen, Germany). The resulting RNA was quantified by using an Agilent 2100 bioanalyzer (Agilent). The amount of acquired RNA is shown in the following Table 1-4.

TABLE 1-4

Amount of RNA

| Sample | Amount of elution (µL) | RNA concentration (ng/µL) |
|---|---|---|
| #1 | 30 | 1682 |
| #2 | 30 | 274 |
| #3 | 30 | 1007 |
| #4 | 30 | 560 |
| #5 | 30 | 988 |
| #6 | 30 | 1327 |

TABLE 1-4-continued

Amount of RNA

| Sample | Amount of elution (µL) | RNA concentration (ng/µL) |
|---|---|---|
| #7 | 30 | 667 |
| #8 | 30 | 258 |
| #9 | 30 | 597 |
| #10 | 30 | 624 |

(2. Synthesis of Complementary DNA and Double Stranded Complementary DNA)

The extracted RNA sample was used to carry out adaptor-ligation PCR. The method was carried out in accordance with the method shown in Preparation Example 1. Specifically, a BSL-18E primer (Table 1-5) and RNA were admixed and annealed, and then a reverse transcriptase was used to synthesize a complementary strand DNA. A double-stranded DNA was subsequently synthesized. Furthermore, T4 DNA polymerase was used to perform a 5' terminal blunting reaction. After column purification by a High Pure PCR Cleanup Micro Kit (Roche), a P20EA/P10EA adaptor was added in a ligation reaction. An adaptor added double stranded complementary DNA purified by a column was digested by a NotI restriction enzyme.

TABLE 1-5

Primer sequences

| Primer | Sequence |
|---|---|
| BSL-18E | AAAGCGGCCGCATGCTTTTTTTTTTTTTTTTTVN (SEQ ID NO: 32) |
| P20EA | TAATACGACTCCGAATTCCC (SEQ ID NO: 33) |
| P10EA | GGGAATTCGG (SEQ ID NO: 34) |
| CA1 | TGTTGAAGGCGTTTGCACATGCA (SEQ ID NO: 35) |
| CA2 | GTGCATAGACCTCATGTCTAGCA (SEQ ID NO: 36) |
| CB1 | GAACTGGACTTGACAGCGGAACT (SEQ ID NO: 37) |
| CB2 | AGGCAGTATCTGGAGTCATTGAG (SEQ ID NO: 38) |

(3. PCR)

1st PCR amplification was performed for a first PCR amplification reaction product from a double stranded complementary DNA by using a common adaptor primer P20EA and a TCRα chain or β chain C region specific primer (CA1 or CB1) shown in Table 1-1. PCR was performed for 20 cycles of a cycle of 30 seconds at 95° C., 30 seconds at 55° C., and one minute at 72° C. with the following reaction composition.

TABLE 1-2A

1st PCR amplification reaction composition

| | Content (μL) | Final concentration |
|---|---|---|
| 2x ExTaq Premix (Takara) | 10 | 10 mM Tris-HCl (pH 8.3) 50 mM KCl 2 mM MgCl$_2$ 0.2 mM dNTPs 0.5 U ExTaq polymerase |
| 10 mM P20EA primer | 0.5 | 250 nM |
| 10 mM CA1 or CB1 primer | 0.5 | 250 nM |
| Double stranded complementary DNA | 2 | |
| Sterilized water | 7 | |

A 1st PCR amplicon was then used to perform 2nd PCR with the reaction composition shown below by using a P20EA primer and a TCRα chain or β chain C region specific primer (CA2 or CB2). 20 cycles of PCR were performed, where a cycle was 30 seconds at 95° C., 30 seconds at 55° C., and one minute at 72° C.

TABLE 1-2B

2nd PCR amplification reaction composition

| | Content (μL) | Final concentration |
|---|---|---|
| 2x ExTaq Premix (Takara) | 10 | 10 mM Tris-HCl (pH 8.3) 50 mM KCl 2 mM MgCl$_2$ 0.2 mM dNTPs 0.5 U ExTaq polymerase |
| 10 mM P20EA primer | 1 | 500 nM |
| 10 mM CA2 or CB2 primer | 1 | 500 nM |
| 1st PCR amplicon | 2 | |
| Sterilized water | 6 | |

A primer was removed with a High Pure PCR Cleanup Micro Kit (Roche) from a 2nd PCR amplicon, which is a product obtained from the second PCR amplification reaction. Furthermore, analysis was carried out with Roche's next generation sequence analyzer (GS Junior Bench Top system), with the 2nd PCR amplicon diluted 10 fold as a template. Amplification utilized a B-P20EA primer, which is a P20EA adaptor primer added with an adaptor B sequence, and HuVaF-01-HuVaF10 (α chain) and HuVbF-01-HuVbF-10 (β chain), which are TCRα chain or β chain C region specific primers added with an adaptor A sequence and each MID Tag sequence (MID-1 to 26) shown in FIG. 10. The primer sequences used are shown in Table 1-6. 10 cycles of PCR were performed, where a cycle was 30 seconds at 95° C., 30 seconds at 55° C., and one minute at 72° C. To confirm PCR amplification, 10 μL of amplicon was amplified by 2% agarose gel electrophoresis (FIG. 11).

TABLE 1-6

Sequencing primer

| Primer | Sequence | | MID tag |
|---|---|---|---|
| HuVaF-01 | CCATCTCATCCCTGCGTGTCTCCGACTCAGACGAGTGCGTATAGGCAGACAGACTTGTCACTG | (SEQ ID NO: 40) | MID-1 |
| HuVaF-02 | CCATCTCATCCCTGCGTGTCTCCGACTCAGACGCTCGACAATAGGCAGACAGACTTGTCACTG | (SEQ ID NO: 41) | MID-2 |
| HuVaF-03 | CCATCTCATCCCTGCGTGTCTCCGACTCAGAGACGCACTCATAGGCAGACAGACTTGTCACTG | (SEQ ID NO: 42) | MID-3 |
| HuVaF-04 | CCATCTCATCCCTGCGTGTCTCCGACTCAGAGCACTGTAGATAGGCAGACAGACTTGTCACTG | (SEQ ID NO: 43) | MID-4 |
| HuVaF-05 | CCATCTCATCCCTGCGTGTCTCCGACTCAGATCAGACACGATAGGCAGACAGACTTGTCACTG | (SEQ ID NO: 44) | MID-5 |
| HuVaF-06 | CCATCTCATCCCTGCGTGTCTCCGACTCAGATATCGCGAGATAGGCAGACAGACTTGTCACTG | (SEQ ID NO: 45) | MID-6 |
| HuVaF-07 | CCATCTCATCCCTGCGTGTCTCCGACTCAGCGTGTCTCTAATAGGCAGACAGACTTGTCACTG | (SEQ ID NO: 46) | MID-7 |
| HuVaF-08 | CCATCTCATCCCTGCGTGTCTCCGACTCAGCTCGCGTGTCATAGGCAGACAGACTTGTCACTG | (SEQ ID NO: 47) | MID-8 |
| HuVaF-09 | CCATCTCATCCCTGCGTGTCTCCGACTCAGTCTCTATGCGATAGGCAGACAGACTTGTCACTG | (SEO ID NO: 48) | MID-10 |
| HuVaF-10 | CCATCTCATCCCTGCGTGTCTCCGACTCAGTGATACGTCTATAGGCAGACAGACTTGTCACTG | (SEQ ID NO: 49) | MID-11 |
| HuVbF-01 | CCATCTCATCCCTGCGTGTCTCCGACTCAGATACGACGTAACACCAGTGTGGCCTTTTGGGTG | (SEQ ID NO: 50) | MID-15 |
| HuVbF-02 | CCATCTCATCCCTGCGTGTCTCCGACTCAGTCACGTACTAACACCAGTGTGGCCTTTTGGGTG | (SEQ ID NO: 51) | MID-16 |
| HuVaF-03 | CCATCTCATCCCTGCGTGTCTCCGACTCAGCGTCTAGTACACACCAGTGTGGCCTTTTGGGTG | (SEQ ID NO: 54) | MID-17 |
| HuVbF-04 | CCATCTCATCCCTGCGTGTCTCCGACTCAGTCTACGTAGCACACCAGTGTGGCCTTTTGGGTG | (SEQ ID NO: 53) | MID-18 |
| HuVbF-05 | CCATCTCATCCCTGCGTGTCTCCGACTCAGTGTACTACTCACACCAGTGTGGCCTTTTGGGTG | (SEQ ID NO: 54) | MID-19 |
| HuVbF-06 | CCATCTCATCCCTGCGTGTCTCCGACTCAGACGACTACAGACACCAGTGTGGCCTTTTGGGTG | (SEQ ID NO: 55) | MID-20 |
| HuVbF-07 | CCATCTCATCCCTGCGTGTCTCCGACTCAGCGTAGACTAGACACCAGTGTGGCCTTTTGGGTG | (SEQ ID NO: 56) | MID-21 |

TABLE 1-6-continued

Sequencing primer

| Primer | Sequence | MID tag |
|---|---|---|
| HuVbF-08 | CCATCTCATCCCTGCGTGTCTCCGACTCAGTACGAGTATGACACCAGTGTGGCCTTTTGGGTG (SEQ ID NO: 57) | MID-22 |
| HuVbF-09 | CCATCTCATCCCTGCGTGTCTCCGACTCAGTACTCTCGTGACACCAGTGTGGCCTTTTGGGTG (SEQ ID NO: 58) | MID-23 |
| HuVbF-10 | CCATCTCATCCCTGCGTGTCTCCGACTCAGTAGAGACGAGACACCAGTGTGGCCTTTTGGGTG (SEQ ID NO: 59) | MID-24 |
| B-P20EA | CCTATCCCCTGTGTGCCTTGGCAGTCTAATACGACTCCGAATTCCC (SEQ ID NO: 60) | — |

TABLE 1-2C

3rd PCR amplification reaction composition

| | Content (µL) | Final concentration |
|---|---|---|
| 2x ExTaq Premix (Takara) | 10 | 10 mM Tris-HCl (pH 8.3) 50 mM KCl 2 mM MgCl$_2$ 0.2 mM dNTPs 0.5 U ExTaq polymerase |
| 10 mM B-P20EA primer | 1 | 500 nM |
| 10 mM HuVaF or HuVbF)primer | 1 | 500 nM |
| 2nd PCR amplicon | 1 | |
| Sterilized water | 7 | |

After PCR amplification by agarose gel electrophoresis shown in FIG. 11, a band comprising about 600 bp of amplicon was cut out, when visualized, and purified by using a DNA purification kit (QIAEX II Gel Extraction Kit, Qiagen). The amount of DNA from the collected PCR amplicon was measured by using a Quant-T™ PicoGreen® dsDNA Assay Kit (Invitrogen). The collected amounts of DNA from each 10 healthy individual are shown in Table 1-7.

TABLE 1-7

Amount of amplified DNA collected from healthy individuals

| | TCRα chain | | TCRβ chain | |
|---|---|---|---|---|
| Sample | MID Tag | Amount of DNA (ng/µL) | MID Tag | Amount of DNA(ng/µL) |
| #1 | MID-1 | 2286 | MID-15 | 857 |
| #2 | MID-2 | 2840 | MID-16 | 526 |
| #3 | MID-3 | 2970 | MID-17 | 253 |
| #4 | MID-4 | 2982 | MID-18 | 1194 |
| #5 | MID-5 | 3470 | MID-19 | 534 |
| #6 | MID-6 | 3512 | MID-20 | 543 |
| #7 | MID-7 | 3471 | MID-21 | 623 |

TABLE 1-7-continued

Amount of amplified DNA collected from healthy individuals

| | TCRα chain | | TCRβ chain | |
|---|---|---|---|---|
| Sample | MID Tag | Amount of DNA (ng/µL) | MID Tag | Amount of DNA(ng/µL) |
| #8 | MID-8 | 3201 | MID-22 | 756 |
| #9 | MID-10 | 2936 | MID-23 | 744 |
| #10 | MID-11 | 2744 | MID-24 | 798 |

(4. Next Generation Sequencing)

Next generation sequencing was carried out by Roche's GS Junior sequence analyzer. Specifically, a GS Junior Titanium emPCR Kit (Lib-L) was used to carry out emPCR in accordance with the protocol of the manufacturer at the ratio of beads to DNA (copy per beads: cpb) of 0.5. After emPCR, a sequence run was carried out for the beads collected with beads enrichment by using sequence run reagents, GS Junior Titanium Sequencing Kit and PicoTiterPlate Kit, in accordance with the protocol of the manufacturer.

(5. Data Analysis)

The resulting sequence data (SFF file) was classified into read sequences for each MID Tag to create a sequence file in a Fasta format by a software that comes with the GS Junior (sfffile or sffinfo). The resulting mean number of reads was TRA: 17840 reads, TRB: 5122 reads, and the percentage of Raw data of 200 bp or greater was TRA: 34.9-63.7% (mean 42.2%) and TRB: 68.8-78.7% (mean 73.1%) (Table 1-8). The newly developed repertoire analysis software (Repertoire Genesis, patent pending) was then used for collation with reference sequences in the IMGT (the international ImMunoGeneTics information system, www dot imgt dot org) database to assign a V region, D region and J region of each read and determine the CDR3 sequence. The number of assigned reads is shown in Table 1-8. Further, the frequency of the same read was analyzed and usage frequency of V, D, and J chains was studied. FIG. 13 (A-D), 14 (A-D), 15 (A-D), and 16 show TRV and TRJ repertoires generated by using reads obtained with Repertoire Genesis.

TABLE 1-8

| | TRA | | | | TRB | | | |
|---|---|---|---|---|---|---|---|---|
| ID | Number of reads | 200 bp or greater | Ratio | Number of assigned reads | ID | Number of reads | 200 bp or greater | Ratio | Number of assigned reads |
| MID1 | 18429 | 6541 | 35.5% | 5187 | MID15 | 5760 | 4108 | 71.3% | 3438 |
| MID2 | 12954 | 8248 | 63.7% | 6904 | MID16 | 6067 | 4283 | 70.6% | 3487 |
| MID3 | 17866 | 7883 | 44.1% | 6328 | MID17 | 5308 | 4080 | 76.9% | 3420 |
| MID4 | 19055 | 6649 | 34.9% | 5201 | MID18 | 5417 | 4004 | 73.9% | 3501 |
| MID5 | 17837 | 7974 | 44.7% | 6374 | MID19 | 3314 | 2279 | 68.8% | 1914 |

TABLE 1-8-continued

| | TRA | | | | | TRB | | | |
| --- | --- | --- | --- | --- | --- | --- | --- | --- | --- |
| ID | Number of reads | 200 bp or greater | Ratio | Number of assigned reads | ID | Number of reads | 200 bp or greater | Ratio | Number of assigned reads |
| MID6 | 15872 | 7467 | 47.0% | 5925 | MID20 | 3365 | 2364 | 70.3% | 2044 |
| MID7 | 17208 | 7581 | 44.1% | 5735 | MID21 | 5722 | 4181 | 73.1% | 3609 |
| MID8 | 17184 | 7309 | 42.5% | 5656 | MID22 | 6148 | 4453 | 72.4% | 3754 |
| MID10 | 21422 | 8175 | 38.2% | 6502 | MID23 | 5462 | 4047 | 74.1% | 3453 |
| MID11 | 20569 | 7519 | 36.6% | 5989 | MID24 | 4657 | 3665 | 78.7% | 3252 |
| Mean | 17840 | 7535 | 42.2% | 5980 | Mean | 5122 | 3746 | 73.1% | 3187 |

Figure 10:
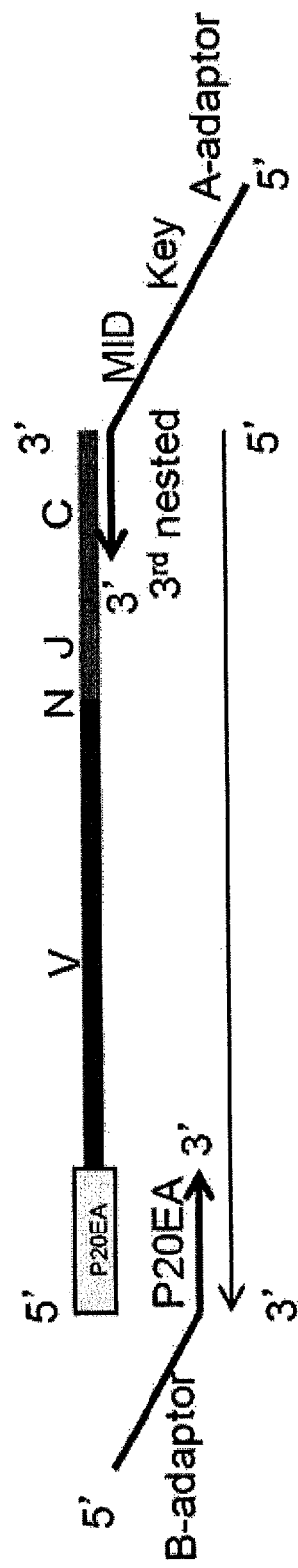
FIG. 10 shows a schematic diagram of an amplification method of a TCR gene. Explanation is provided for a primer pair exemplified in the Examples. Amplification was performed with a B-P20EA primer which is a P20EA adaptor primer added with an adaptor sequence, B-adaptor, and a primer which is a 3$^{rd}$ nested primer added with an A-adaptor and an identification sequence, MID Tag sequence (denoted as MID, MID-1 to 26). Key indicates TCAG.
Figure 11:
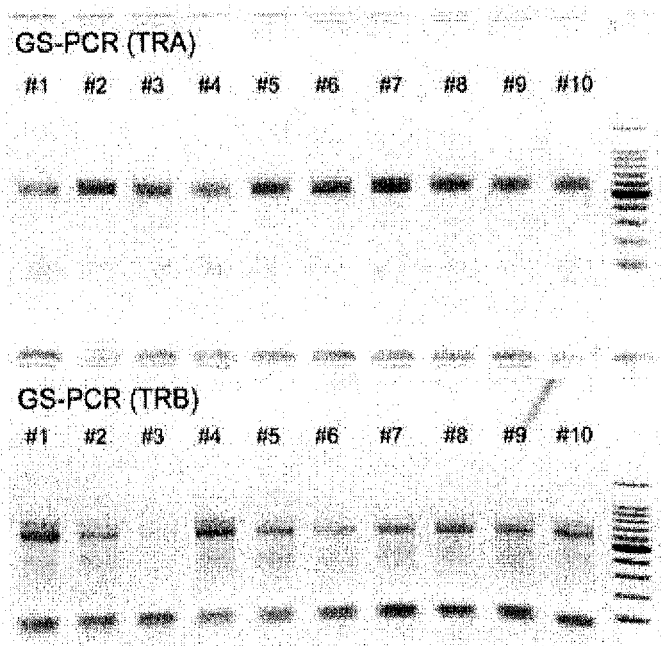
FIG. 11 shows results of electrophoresis of 10 μL of GS-PCR amplicon derived from 10 healthy individuals with 2% agarose gel. The top row shows GS-PCR (TRA) and TCRα chain amplicon, and bottom row shows GS-PCR (TRB) and TCRβ chain amplicon. The numbers indicate sample numbers.

FIG. 10 shows an amplification method of a TCR gene. Amplification was performed with a B-P20EA primer which is a P20EA adaptor primer added with a B-adaptor, and a primer which is a $3^{rd}$ nested primer added with an A-adaptor and an MID Tag sequence (MID-1 to 26).

FIG. 11 shows results of examining GS-PCR amplicons. Electrophoresis was performed on 10 μL of GS-PCR amplicons derived from 10 healthy individuals with 2% agarose gel. The top row shows GS-PCR (TRA) (TCRα chain amplicon), and bottom row shows GS-PCR (TRB) (TCRβ chain amplicon).

Figure 12:
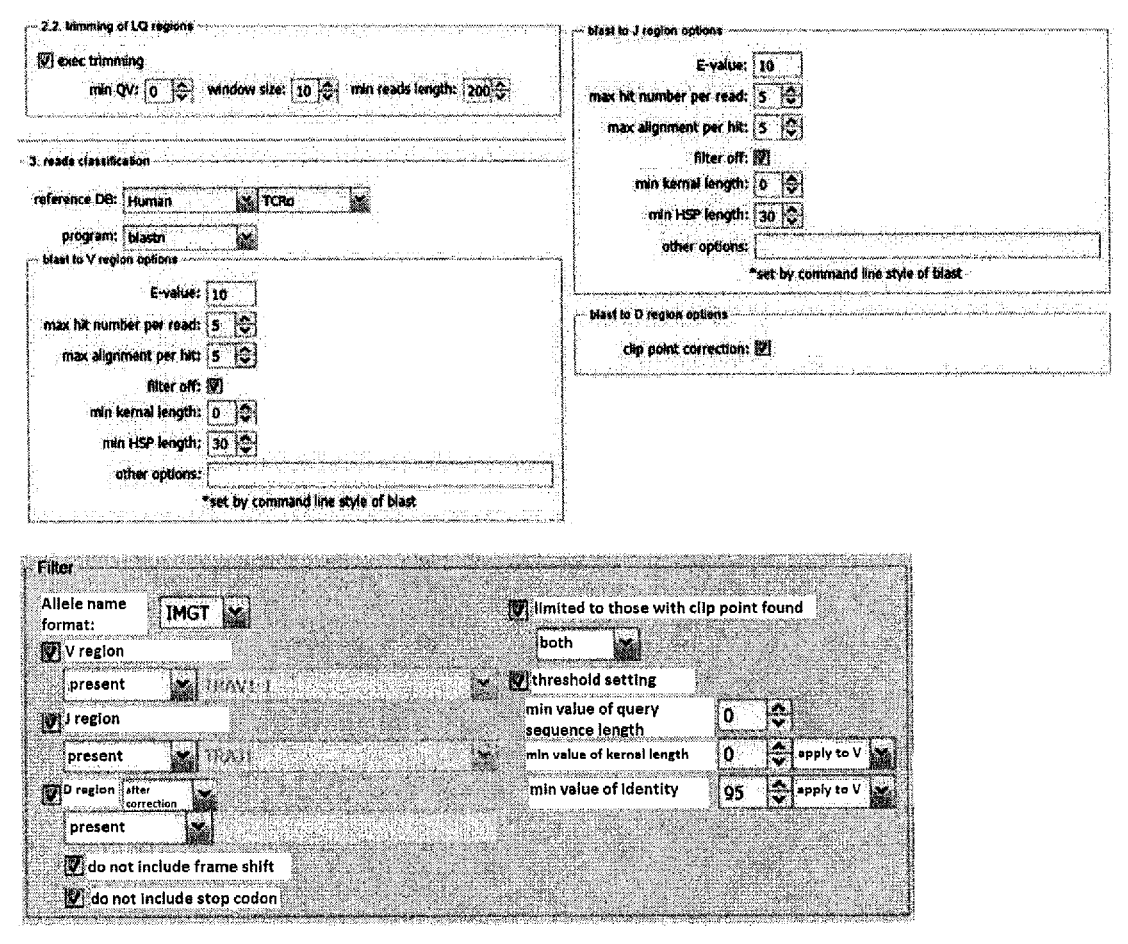

FIG. 12 shows a parameter setting of a TCR/BCR repertoire analysis software (Repertoire genesis).

FIG. 13 shows a TRAV repertoire in health individuals. A TRAV repertoire for 10 healthy individuals and the mean value thereof are shown. The frequency of presence of TRAV9-2, 12 and 13 are high. TRAV20 in #1 and TRAV21 in #5 are higher than other healthy individuals, exhibiting variations among individuals.

Figure 14B:
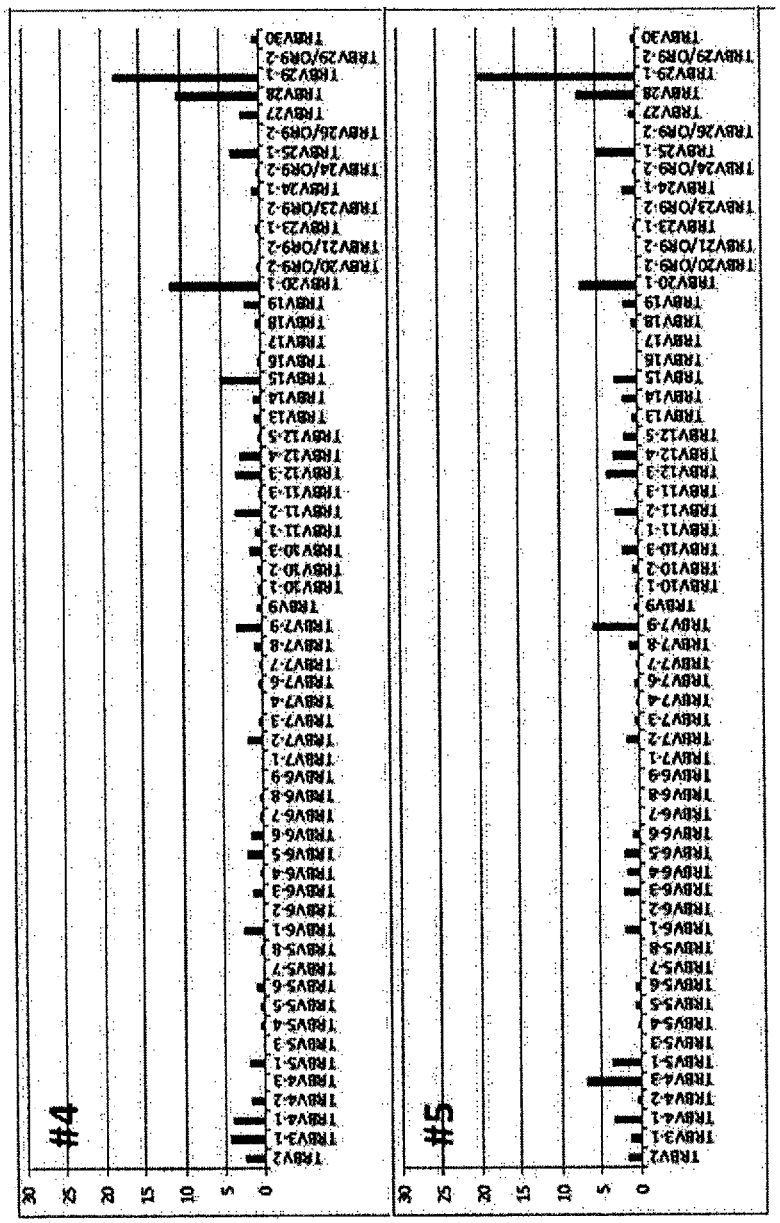
FIG. 14 (A-D) show results of analysis of a TRBV repertoire in healthy individuals. Each figure shows a TRABV repertoire for each sample (see numbers). The horizontal axis indicates each TRBV gene name and the vertical axis indicates the frequency of presence thereof. Mean indicates the mean. A TRBV repertoire for 10 healthy individuals and the mean value thereof are shown. The frequency of presence of TRBV20-1, 28 and 29-1 were high. TRBV3-1 in #8 was higher than other healthy individuals, exhibiting variations among individuals.

FIG. 14 shows a TRBV repertoire in healthy individuals. A TRBV repertoire for 10 healthy individuals and the mean value thereof are shown. The frequency of presence of TRBV20-1, 28 and 29-1 are high. TRBV3-1 in #8 was higher than other healthy individuals, exhibiting variations among individuals.

FIG. 15 shows a TRAJ repertoire in healthy individuals. A TRAJ repertoire for 10 healthy individuals and the mean value thereof are shown. A TRAJ repertoire of healthy individuals showed about 5% or less in any AJ family. TRAJ12 in #1, TRAJ27 in #4, TRAJ37 in #5, and TRAJ45 in #8 were higher than other healthy individuals, exhibiting variations among individuals.

Figure 16:
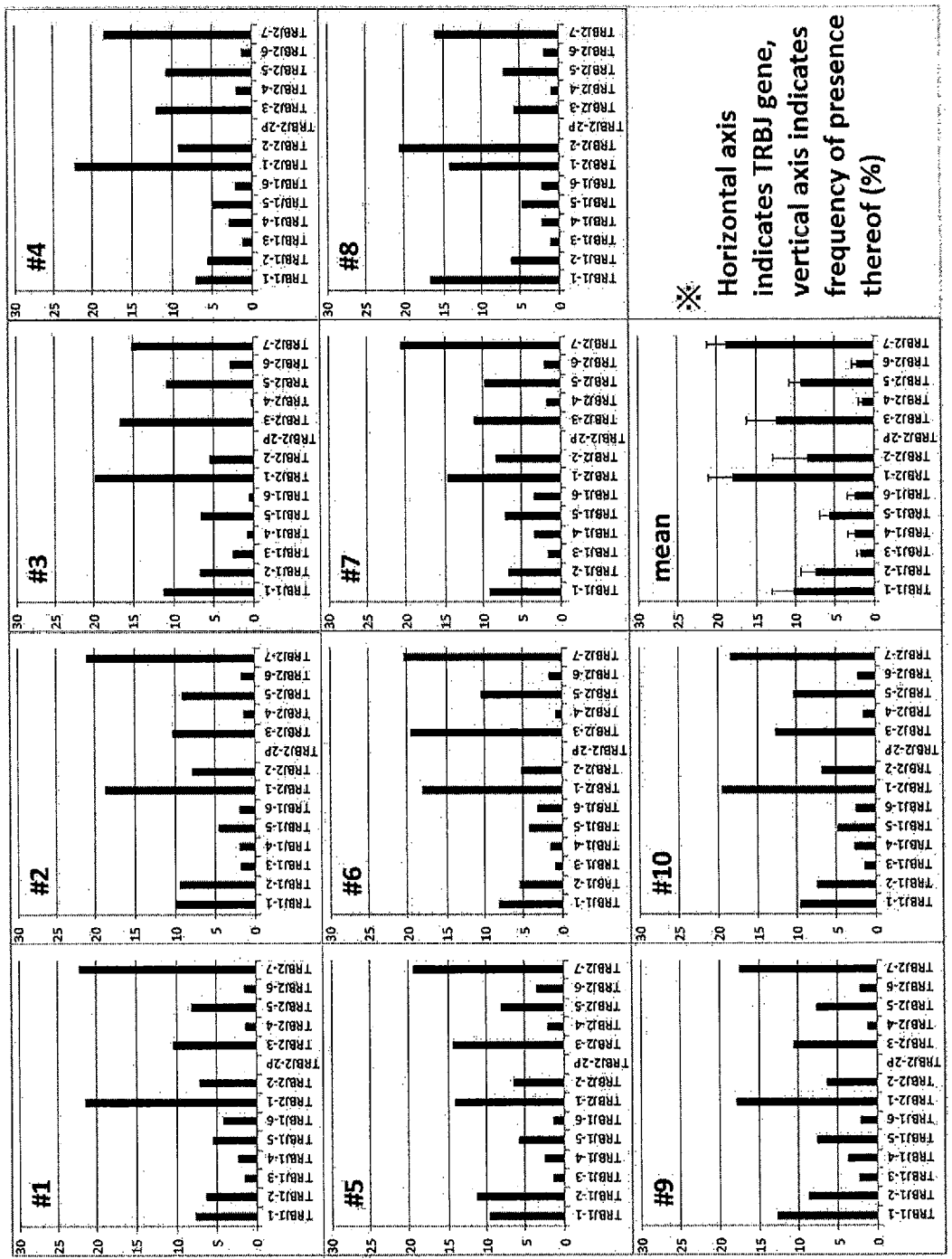
FIG. 16 shows results of analysis of a TRBJ repertoire in healthy individuals. The horizontal axis indicates each TRBJ gene name and the vertical axis indicates the frequency of presence thereof. Mean indicates the mean. A TRBJ repertoire for 10 healthy individuals and the mean value thereof are shown. The frequency of presence of TRBJ2-1, 2-3, and 2-7 were high and TRBJ2-2 was high in #8 in TRBJ repertoires of healthy individuals, exhibiting variations among individuals.

FIG. 16 shows a TRBJ repertoire in healthy individuals. A TRBJ repertoire for 10 healthy individuals and the mean value thereof are shown. The frequency of presence of TRBJ2-1, 2-3, and 2-7 was high and TRBJ2-2 was high in #8 in TRBJ repertoires of healthy individuals, exhibiting variations among individuals.

Thus, it was proven that unbiased quantitative analysis is also possible in TCRs by using a sample prepared by the preparation method of the present invention.

Preparation Example 3

Amplification of TCR and BCR Genes by Unbiased Adaptor-Ligation PCR

In the present Example, TCR and BCR genes are amplified by unbiased adaptor-ligation PCR>
(Materials and Methods)
(Sample)
Peripheral blood mononuclear cells of a healthy individual
(Method)
(1. RNA Extraction)
5 mL of whole blood was collected from one healthy individual in a heparin-containing blood collection tube. Peripheral blood mononuclear cells (PBMC) were separated by ficoll density gradient centrifugation. Total RNA was extracted/purified from the isolated $5 \times 10^6$ PBMCs by using an RNeasy Lipid Tissue Mini Kit (QIAGEN, Germany).
(2. Synthesis of Complementary DNA and Double Stranded Complementary DNA)
The extracted RNA sample was used to carry out an adaptor-ligation PCR. First, in order to synthesize a complementary DNA, a BSL-18E primer (Table 1-1) and 3.5 μL (812 ng) of RNA were admixed and annealed for 8 minutes at 70° C. After cooling on ice, a reverse transcription reaction was performed in the presence of an RNase inhibitor (RNAsin) to synthesize a complementary DNA with the following composition.

TABLE 1-3A

Synthesis of complementary DNA

| Reagent | Content (μL) | Final concentration |
| --- | --- | --- |
| RNA solution | 3.5 | |
| 200 μM BSL-18E | 1.5 | 30 μM |
| | Total 5 | 70° C., 8 minutes |
| 5x First strand buffer | 2 | 50 mM Tris-HCl, pH 8.3, 75 mM KCl, 3 mM MgCl₂ |
| 0.1M DTT | 1 | 10 mM |
| 10 mM dNTPs | 0.5 | 500 μM |
| RNasin (Promega) | 0.5 | 2 U/μL |
| Superscript III ™, 200 U/μL (Invitrogen) | 1 | 20 U/μL |

The complementary DNA was subsequently incubated for hours at 16° C. in the following double-stranded DNA synthesis buffer in the presence of *E. coli* DNA polymerase I, E. coli DNA Ligase, and RNase H to synthesize a double stranded complementary DNA. Furthermore, T4 DNA polymerase was reacted for 5 minutes at 16° C. to perform a 5' terminal blunting reaction.

TABLE 1-3B

Synthesis of complementary double stranded DNA

| Reagent | Content (µL) | Final concentration |
|---|---|---|
| Comlementary DNA reaction solution | 9 | |
| Sterilized water | 46.5 | |
| 5x Second strand buffer | 15 | 25 mM Tris-HCl, pH 7.5, 100 mM KCl, 5 mM $MgCl_2$, 10 mM $(NH_4)SO_4$, 0.15 mM β-NAD+, 1.2 mM DTT |
| 10 mM dNTPs | 1.5 | 0.2 mM |
| E. coli DNA ligase, 10 U/µL (Invitrogen) | 0.5 | 0.067 U/µL |
| E. coli DNA polymerase, 10 U/µL (Invitrogen) | 2 | 0.27 U/µL |
| RNaseH, 2 U/µL (Invitrogen) | 0.5 | 0.013 U/µL |
| Total | 75 µL | 16° C., 2 hours |
| T4 DNA polymerase, 5 U/µL (Invitrogen) | 1 | 0.067 U/µL |
| | | 16° C., 5 minutes |

A double stranded DNA, after column purification by a High Pure PCR Cleanup Micro Kit (Roche), was incubated all night at 16° C. in the presence of a P20EA/10EA adaptor (Table 1-1) and T4 ligase in the following T4 ligase buffer for a ligation reaction.

TABLE 1-3C

Adaptor adding reaction

| Reagent | Content (µL) | Final concentration |
|---|---|---|
| Comlementary double stranded DNA solution | 12.5 | |
| T4 ligase buffer | 5 | 50 mM Tris-HCl, pH 7.6, 10 mM $MgCl_2$, 1 mM ATP, 5% PEG5000, 1 mM DTT |
| 50 µM P20EA/10EA adaptor | 5 | 10 µM |
| T4 DNA ligase, 1 U/µL (Invitrogen) | 2.5 | 0.1 U/µL |
| Total | 25 | 16° C., all night |

An adaptor added double stranded DNA purified by a column as discussed above was digested by a NotI restriction enzyme (50 U/µL, Takara) with the following composition in order to remove an adaptor added to the 3' terminal.

TABLE 1-3D

Restriction enzyme treatment

| Reagent | Content (µL) | Final concentration |
|---|---|---|
| Complementary double stranded DNA solution | 34 | |
| 10x restriction enzyme buffer | 5 | 50 mM Tris-HCl, pH 7.5, 10 mM $MgCl_2$, 1 mM, 1 mM DTT, 100 mM NaCl |

TABLE 1-3D-continued

Restriction enzyme treatment

| Reagent | Content (µL) | Final concentration |
|---|---|---|
| 0.1% BSA | 5 | 0.01% |
| 0.1% Triton X-100 | 5 | 0.01% |
| NotI, 50 U/µL (Takara) | 1 | 1 U/µL |
| Total | 50 | 37° C., 2 hours |

The $1^{st}$ PCR from a double stranded complementary DNA was performed by using a common adaptor primer P20EA and TCR C region specific primer (CA1, CB1, CG1, CD1), or immunoglobulin isotype C region specific primer (CM1, CA1, CG1, CD1, CE1, CK1, CL1). A primer was set at the 3' terminal side, middle portion or 5' side of a C region such that a sequence comprising the full length of the C region can be amplified. 20 cycles were performed, where a cycle was 30 seconds at 95° C., 30 seconds at 55° C., and one minute at 72° C. with the following reaction composition. The primer sequences used are shown in Table 1-1.

TABLE 1-3E

1st PCR amplification reaction composition

| Reagent | Content (µL) | Final concentration |
|---|---|---|
| 2x ExTaq Premix (Takara) | 10 | 10 mM Tris-HCl (pH 8.3) 50 mM KCl 2 mM $MgCl_2$ 0.2 mM dNTPs 0.5 U ExTaq polymerase |
| 10 mM P20EA primer | 0.5 | 250 nM |
| 10 mM specific Primer: TRAC(2 types), TRBC(3 types), TRGC(2 types), TRDC(2 types), IGHM(3 types), IGHG(3 types), IGHA (3 types), IGHD(3 types), IGHE(3 types), IGLK(1 type), IGLL(1 type) | 0.5 | 250 nM |
| Double stranded complementary DNA | 2 | |
| Sterilized water | 7 | |

The $1^{st}$ PCR amplicon, which is a product of the first PCR amplification reaction, was then used to perform nested PCR with the reaction composition shown below between a P20EA primer and each of the immunoglobulin isotype C region specific primers. 20 cycles of PCR were performed, where a cycle was 30 seconds at 95° C., 30 seconds at 55° C., and one minute at 72° C. The primer sequences used are shown in Table 1-1.

TABLE 1-3F $2^{nd}$ PCR amplification reaction composition

| Reagent | Content (µL) | Final concentration |
|---|---|---|
| 2x ExTaq Premix Takara | 10 | 10 mM Tris-HCl (pH 8.3) 50 mM KCl 2 mM $MgCl_2$ 0.2 mM dNTPs 0.5 U ExTaq polymerase |

TABLE 1-3F-continued

2nd PCR amplification reaction composition

| Reagent | Content (μL) | Final concentration |
|---|---|---|
| 10 mM P20EA primer | 1 | 500 nM |
| 10 mM specific Primer: TRAC(2 types), TRBC(3 types), TRGC(2 types), TRDC(2 types), IGHM(3 types), IGHG(3 types), IGHA(3 types), IGHD(3 types), IGHE(3 types), IGLK(1 type), IGLL(1 type) | 1 | 500 nM |

TABLE 1-3F-continued

2nd PCR amplification reaction composition

| Reagent | Content (μL) | Final concentration |
|---|---|---|
| 1st PCR amplicon | 2 | |
| Sterilized water | 6 | |

Amplicons with a size of interest, when visualized, were observed as a result of electrophoresis of each $2^{nd}$ PCR amplicon synthesized by the second PCR amplification reaction with 2% agarose gel (FIG. 17).

TABLE 1-9

Primer sequences

| Primer | Target | Step | Sequence |
|---|---|---|---|
| BSL-18E | All | cDNA primer | AAAGCGGCCGCATGCTTTTTTTTTTTTTTTTVN (SEQ ID NO: 1116) |
| P20EA | All | Adaptor | TAATACGACTCCGAATTCCC (SEQ ID NO: 1117) |
| P10EA | All | Adaptor | GGGAATTCGG (SEQ ID NO: 1118) |
| TCR primers | | | |
| CA1 | TRAC | 1st | TGTTGAAGGCGTTTGCACATGCA (SEQ ID NO: 1119) |
| CA2 | TRAC | 2nd | GTGCATAGACCTCATGTCTAGCA (SEQ ID NO: 1120) |
| TRAC-3ter-1st | TRAC | 1st | CAGCGTCATGAGCAGATT (SEQ ID NO: 1121) |
| TRAC-3ter-2nd | TRAC | 2nd | ACTTTCAGGAGGAGGATT (SEQ ID NO: 1122) |
| CB1 | TRBC | 1st | GAACTGGACTTGACAGCGGAACT (SEQ ID NO: 1123) |
| CB2 | TRBC | 2nd | AGGCAGTATCTGGAGTCATTGAG (SEQ ID NO: 1124) |
| TRBC-Center-1st | TRBC | 1st | ACAGTCTGCTCTACCCCA (SEQ ID NO: 1125) |
| TRBC-Center-2nd | TRB | 2nd | GTCCACTCGTCATTCTCC (SEQ ID NO: 1126) |
| TRBC-3ter-1st | TRBC | 1st | GAATCCTTTCTCTTGACC (SEQ ID NO: 1127) |
| TRBC-3ter-2nd | TRBC | 2nd | TTCCCTAGCAAGATCTCATA (i SEQ ID NO: 1128) |
| BCR primers | | | |
| CM1 | IGHM | 1st | TCCTGTGCGAGGCAGCCAA (SEQ ID NO: 1129) |
| CM2 | IGHM | 2nd | GTATCCGACGGGGAATTCTC (SEQ ID NO: 1130) |
| IGHM-Cent-1st | IGHM | 1st | GATGTTGGTGTGGGTTTTCA (SEQ ID NO: 1131) |
| IGHM Cent-2nd | IGHM | 2nd | ATAGGTGGTCAGGTCTGTGA (SEQ ID NO: 1132) |
| IGHM-3ter-1st | IGHM | 1st | TAGAAGAGGCTCAGGAGGAA (SEQ ID NO: 1133) |
| IGHM-3ter-2nd | IGHM | 2nd | TTCCATTCCTCTTCGGACAC (SEQ ID NO: 1134) |
| CA1 | IGHA | 1st | GCTGGCTGCTCGTGGTGTAC (SEQ ID NO: 1135) |
| CA2 | IGHA | 2nd | GGGAAGTTTCTGGCGGTCACG (SEQ ID NO: 1136) |
| IGHA-Cent-1st | IGHA | 1st | GAATGTGTTTCCGGATTTTG (SEQ ID NO: 1137) |
| IGHA-Cent-2nd | IGHA | 2nd | TAGCAGCCACAGAGGTCA (SEQ ID NO: 1138) |
| IGHA-3ter-1st | IGHA | 1st | GCCATGACAACAGACACATT (SEQ ID NO: 1139) |

TABLE 1-9-continued

Primer sequences

| Primer | Target | Step | Sequence |
|---|---|---|---|
| IGHA-3ter-2nd | IGHA | 2nd | GGTCGATGGTCTTCTGTGT (SEQ ID NO: 1140) |
| CG1 | IGHG | 1st | CACCTTGGTGTTGCTGGGCTT (SEQ ID NO: 1141) |
| CG2 | IGHG | 2nd | TCCTGAGGACTGTAGGACAGC (SEQ ID NO: 1142) |

FIGS. 18-25 show a primer position with respect to a template. The figures show that a significant range of regions is suitable as a PCR primer of interest of the present invention. It is also understood that a specific sequence can be appropriately determined based on the principles of the present invention.

Preparation Example 4

Detection of Tumor Cells Using Human Acute Lymphoblastic Leukemia Cell Line

Tumor cells were detected using a human acute lymphoblastic leukemia cell line in the present Example.
(Materials and Methods)
(Sample)
Peripheral blood mononuclear cells of a healthy individual, MOLT-4 human acute lymphoblastic leukemia cell line
(Method)
(1. Culture of T Cell Based Leukemia Cell Line)
A human acute lymphoblastic leukemia cell line Molt-4 was used as a T cell based cell line expressing a T cell receptor (TCR). Cells were cultured in an RPMI-1640 medium comprising 10% fetal bovine serum, 100 IU/ml penicillin, 100 µg/ml streptomycin, and 2 mM L-glutamine under the condition of 5% $CO_2$ at 37° C. A total of $1×10^7$ cells were collected. The cells were washed and suspended in the RPMI-1640 medium such that $1×10^6$ cells/mL.
(2. Separation of Peripheral Blood Mononuclear Cells of Healthy Individual)
5 mL of whole blood was collected from one healthy individual in a heparin-containing blood collection tube. Peripheral blood mononuclear cells (PBMC) were separated by ficoll density gradient centrifugation. The cells were washed, counted, and suspended in the RPMI 1640 medium such that $1×10^6$ cells/mL.
(3. Preparation of Serial Diluent of Cells)
The resulting $1×10^6$ cells/mL PBMCs and $1×10^6$ cells/mL Molt-4 cells were mixed so as to have the following number of cells to prepare a MOlt-4 serially diluted cell suspension.

TABLE 1-4A

| | PBMC | Molt-4 |
|---|---|---|
| 100% | 0 | $1 × 10^6$ |
| 10% | $9 × 10^5$ | $1 × 10^5$ |
| 1% | $9.9 × 10^5$ | $1 × 10^4$ |
| 0.1% | $9.99 × 10^5$ | $1 × 10^3$ |
| 0.01% | $9.999 × 10^5$ | $1 × 10^2$ |

Figure 26:
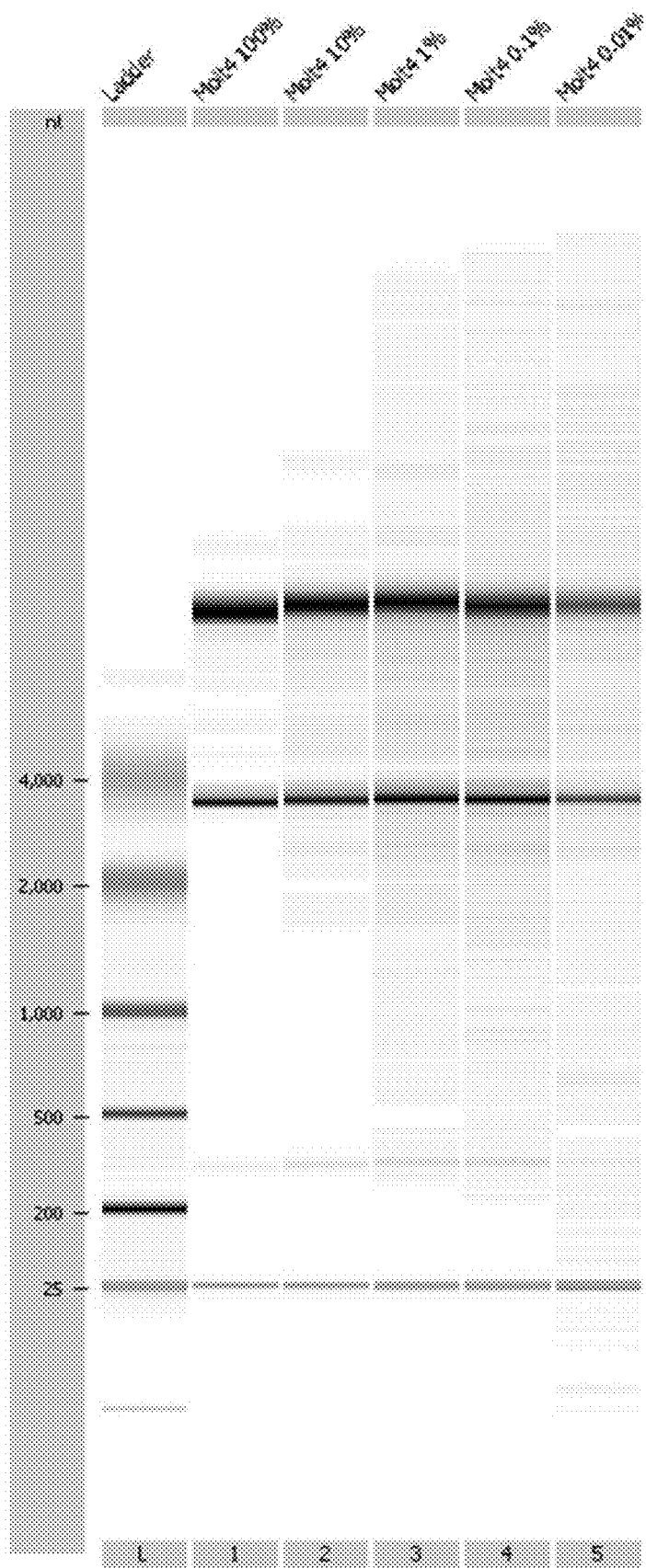
FIG. 26 shows an image of RNA electrophoresis by an Agilent 2100 bioanalyzer. Total RNA was extracted from a serially diluted cell solution and the amount of RNA was measured with an Agilent bioanalyzer. A RNA was separated with a microchip electrophoretic apparatus to check the quality of the RNA. 28S (top band) and 18S rRNA (bottom band) were detected in each sample, demonstrating that a RNA which has not been degraded was obtained.

(4. RNA Extraction and Measurement of Amount of RNA)
Total RNA was extracted/purified from the serially diluted cell suspension by using an RNeasy Lipid Tissue Mini Kit (QIAGEN, Germany). The RNA was eluted in 20 µL eluate. The amount of RNA was quantified by absorbance of A260 bp using an Agilent 2100 bioanalyzer (Agilent). FIG. 26 shows an image of RNA electrophoresis. The amount of RNA obtained from each sample is shown in Table 1-4B.

TABLE 1-4B

Amount of RNA obtained from each sample

| Sample | Concentration (ng/µL) | Ratio (A260/A280) | Total amount of RNA (µg) |
|---|---|---|---|
| 100% | 122 | 2.0 | 1.22 |
| 10% | 130 | 1.9 | 1.3 |
| 1% | 82 | 1.7 | 0.82 |
| 0.1% | 62 | 0.8 | 0.62 |
| 0.01% | 30 | 0.8 | 0.3 |

(5. Synthesis of Complementary DNA and Double Stranded Complementary DNA)
The extracted RNA sample was used to carry out adaptor-ligation PCR. First, in order to synthesize a complementary DNA, a BSL-18E primer and 3.5 µL of RNA were admixed and annealed for 8 minutes at 70° C. After cooling on ice, a reverse transcription reaction was performed in the presence of an RNase inhibitor (RNAsin) to synthesize a complementary DNA with the following composition.

TABLE 1-4C

Synthesis of complementary DNA

| Reagent | Content (µL) | Final concentration |
|---|---|---|
| RNA solution | 3.5 | |
| 200 µM BSL-18E | 1.5 | 30 µM |
| | Total 5 | 70° C., 8 minutes |
| 5x First strand buffer | 2 | 50 mM Tris-HCl, pH 8.3, 75 mM KCl, 3 mM $MgCl_2$ |
| 0.1M DTT | 1 | 10 mM |
| 10 mM dNTPs | 0.5 | 500 µM |
| RNasin (Promega) | 0.5 | 2 U/µL |
| Superscript III ™, 200 U/µL (Invitrogen) | 1 | 20 U/µL |

The complementary. DNA was subsequently incubated for hours at 16° C. in the following double-stranded DNA synthesis buffer in the presence of E. coli DNA polymerase I, E. coli DNA Ligase, and RNase H to synthesize a double stranded complementary DNA. Furthermore, T4 DNA polymerase was reacted for 5 minutes at 16° C. to perform a 5' terminal blunting reaction.

TABLE 1-4D

Synthesis of complementary double stranded DNA

| Reagent | Content (μL) | Final concentration |
|---|---|---|
| Complementary DNA reaction solution | 9 | |
| Sterilized water | 46.5 | |
| 5x Second strand buffer | 15 | 25 mM Tris-HCl, pH 7.5, 100 mM KCl, 5 mM $MgCl_2$, 10 mM $(NH_4)SO_4$, 0.15 mM β-NAD+, 1.2 mM DTT |
| 10 mM dNTPs | 1.5 | 0.2 mM |
| E. coli DNA ligase, 10 U/μL (Invitrogen) | 0.5 | 0.067 U/μL |
| E. coli DNA polymerase, 10 U/μL (Invitrogen) | 2 | 0.27 U/μL |
| RNaseH, 2 U/μL (Invitrogen) | 0.5 | 0.013 U/μL |
| | Total 75 μL | 16° C., 2 hours |
| T4 DNA polymerase, 5 U/μL (Invitrogen) | 1 | 0.067 U/μL |
| | | 16° C., 5 minutes |

A double stranded DNA, after column purification by a High Pure PCR Cleanup Micro Kit (Roche), was incubated overnight at 16° C. in the presence of a P20EA/10EA adaptor (Table 1-4E) and T4 ligase in the following T4 ligase buffer for a ligation reaction.

TABLE 1-4E

Adaptor adding reaction

| Reagent | Content (μL) | Final concentration |
|---|---|---|
| Complimentary double stranded DNA solution | 12.5 | |
| T4 ligase buffer | 5 | 50 mM Tris-HCl, pH 7.6, 10 mM $MgCl_2$, 1 mM ATP, 5% PEG5000, 1 mM DTT |
| 50 μM P20EA/10EA adaptor | 5 | 10 μM |
| T4 DNA ligase, 1 U/μL (Invitrogen) | 2.5 | 0.1 U/μL |
| | Total 25 | 16° C., all night |

An adaptor added double stranded DNA purified by a column as discussed above was digested by a NotI restriction enzyme (50 U/μL, Takara) with the following composition in order to remove an adaptor added to the 3' terminal.

TABLE 1-4F

Restriction enzyme treatment

| Reagent | Content (μL) | Final concentration |
|---|---|---|
| Complementary double stranded DNA solution | 34 | |
| 10x restriction enzyme buffer | 5 | 50 mM Tris-HCl, pH 7.5, 10 mM $MgCl_2$, 1 mM, 1 mM DTT, 100 mM NaCl |
| 0.1% BSA | 5 | 0.01% |
| 0.1% Triton X-100 | 5 | 0.01% |
| NotI, 50 U/μL (Takara) | 1 | 1 U/μL |
| | Total 50 | 37° C., 2 hours |

(6. PCR)

The $1^{st}$ PCR amplification was performed by using a common adaptor primer P20EA shown in Table 1-1 and a TCRα chain or β chain C region specific primer (CB1) from a double stranded complementary DNA. 20 cycles of PCR were performed, where a cycle was 30 seconds at 95° C., 30 seconds at 55° C., and one minute at 72° C. with the composition shown below.

TABLE 1-4G $1^{st}$ PCR amplification reaction composition

| | Content (μL) | Final concentration |
|---|---|---|
| 2x ExTaq Premix (Takara) | 10 | 10 mM Tris-HCl (pH 8.3) 50 mM KCl 2 mM $MgCl_2$ 0.2 mM dNTPs 0.5 U ExTaq polymerase |
| 10 mM P20EA primer | 0.5 | 250 nM |
| 10 mM CB1 primer | 0.5 | 250 nM |
| Double stranded complementary DNA | 2 | |
| Sterilized water | 7 | |

A $1^{st}$ PCR amplicon was then used to perform nested PCR with the reaction composition shown below by using a P20EA primer and each immunoglobulin isotype C region specific primer. 20 cycles of PCR were performed, where a cycle was 30 seconds at 95° C., 30 seconds at 55° C., and one minute at 72° C.

TABLE 1-4H $2^{nd}$ PCR amplification reaction composition

| | Content (μL) | Final concentration |
|---|---|---|
| 2x ExTaq Premix (Takara) | 10 | 10 mM Tris-HCl (pH 8.3) 50 mM KCl 2 mM $MgCl_2$ 0.2 mM dNTPs 0.5 U ExTaq polymerase |
| 10 mM P20EA primer | 1 | 500 nM |
| 10 mM CB2 primer | 1 | 500 nM |
| $1^{st}$ PCR amplicon | 2 | |
| Sterilized water | 6 | |

A primer was removed with a High Pure PCR Cleanup Micro Kit (Roche) from the obtained $2^{nd}$ PCR amplicon. Furthermore, analysis was carried out with Roche's next generation sequence analyzer (GS Junior Bench Top system), with the $2^{nd}$ PCR amplicon diluted 10 fold as a template. Amplification utilized a B-P20EA primer, which is a P20EA adaptor primer added with an adaptor B sequence, and HuVbF primer, which is a TCRβ chain C region specific prime added with an adaptor A sequence and each MID Tag sequence. 10 cycles of PCR were performed, where a cycle was 30 seconds at 95° C., 30 seconds at 55° C., and one minute at 72° C.

TABLE 1-4I

3rd PCR amplification reaction composition

| | Content (μL) | Final concentration |
|---|---|---|
| 2x ExTaq Premix (Takara) | 10 | 10 mM Tris-HCl (pH 8.3) 50 mM KCl 2 mM MgCl$_2$ 0.2 mM dNTPs 0.5 U ExTaq polymerase |
| 10 mM B-P20EA primer | 1 | 500 nM |
| 10 mM HuVbF primer | 1 | 500 nM |
| 2$^{nd}$ PCR amplicon | 1 | |
| Sterilized water | 7 | |

(7. Next Generation Sequencing)

Next generation sequencing was carried out by Roche's GS Junior sequence analyzer. Specifically, a GS Junior Titanium emPCR Kit (Lib-L) was used to carry out emPCR in accordance with the protocol of the manufacturer at the ratio of beads to DNA (copy per beads: cpb) of 2. After emPCR, a sequence run was carried out for the beads collected with beads enrichment by using sequence run reagents, GS Junior Titanium Sequencing Kit and PicoTiterPlate Kit, in accordance with the protocol of the manufacturer.

(8. Data Analysis)

The resulting sequence data (SFF file) was classified into read sequences for each MID Tag to create a sequence file in a Fasta format by a software that comes with GS Junior (sfffile or sffinfo). The resulting number of effective reads was 11651. A repertoire analysis software (Repertoire Genesis) was used for collation with reference sequences in the IMGT database to assign a BV region and BJ region of each read and to determine the CDR3 sequence. An in-frame TCR read (Read 1) having a functional sequence and a TCR read (Read 2) causing a frame shift were observed from the Molt-4 cells (Table 1-4J). Each was detected at about the same frequency and estimated to be a TCR gene derived from a Molt-4 cell. Gene rearrangement in two TCR loci has been already reported in Molt-4 cells (Cited Reference 1: Tunnacliffe A, Kefford R, Milstein C, Forster A, Rabbitts T H. Sequence and evolution of the human T-cell antigen receptor beta-chain genes. Proc Natl Acad Sci USA. 1985 August; 82(15): 5068-72.) The sequence of a functional TCR gene (Read 1) matched the already reported sequence (Cited Reference 2: Assaf C, Hummel M, Dippel E, Goerdt S, Muller H H, Anagnostopoulos I, Orfanos C E, Stein H. High detection rate of T-cell receptor beta chain rearrangements in T-cell lymphoproliferations by family specific polymerase chain reaction in combination with the GeneScan technique and DNA sequencing. Blood. 2000 Jul. 15; 96(2):640-6., GenBank Accession number: M12886.1).

TABLE 1-4J

CDR3 amino acid sequence of TCR gene derived from Molt-4

| Read | frame | BV | BJ | CDR3 amino acid sequence |
|---|---|---|---|---|
| 1 | In-frame | TRBV20-1 | TRBJ2-1 | CSARESTSDPKNEQFFG (SEQ ID NO: 1163) |
| 2 | Out-of-frame | TRBV10-3 | TRBJ2-5 | CAISEPTGIRRDPVLR (SEQ ID NO: 1164) |

In order to find out the detection limit of Molt-4 cells by the next generation TCR repertoire analysis method, two TCR reads derived from Molt-4 cells were searched and collated in TCR reads acquired from serially diluted samples (FIG. 27 (A-D)). As a result, Read 1 and Read 2 were detected in accordance with the number of cells in the serially diluted samples. It was confirmed that 61 Reads (3.1%) were present in the 0.1 sample for Read 1 and 1 Read (0.01%) was present in the 0.01% sample for Read 2 (Table 1-4K). The functional TCR, Read 1, was not detected in the 0.01% sample, while Read 2 predicted to lack functionality was detected. This suggests that certainty of tumor cell detection is elevated by searching a plurality of TCR genes derived from one T cell. The results show that the present method can detect tumor cells at high sensitivity.

TABLE 1-4K

Detection sensitivity

| Sample | Read 1 | Read 2 |
|---|---|---|
| 100% | + | + |
| 10% | + | + |
| 1% | + | + |
| 0.1% | + | − |
| 0.01% | − | + |

+: detected
−: not detected (Results)

FIG. 26 shows an image of RNA electrophoresis by an Agilent 2100 bioanalyzer. Total RNA was extracted from a serially diluted cell solution and the amount of RNA was measured with an Agilent bioanalyzer. An RNA was separated with a microchip electrophoretic apparatus to check the quality of the RNA. 28S (top band) and 18S rRNA (bottom band) were detected in each sample, demonstrating that an RNA which has not been degraded was obtained.

FIG. 27 (A-D) show TCR reads in serially diluted Molt-4 cell samples (SEQ ID NOs: 1165-1324). TCR reads acquired from each of 10%, 1%, 0.1%, and 0.01% serially diluted Molt-4 sample are described. The reads were ranked in the order of having a greater number of reads and the top 40 positions are shown. Ranking 365 to 404 are shown for the 0.01% sample. TRBV, TRBJ, and CDR3 amino acid sequences for each read, and number of reads are shown. Functional TCR reads (TRBV20-1/TRBJ2-1/CSARESTSDPKNEQFFG (SEQ ID NO: 1166)) derived from Molt-4 are shown in bold with a gray background. The other TCR reads estimated to have a functional deficiency (TRBV10-3/TRBJ2-5/CAISEPTGIRRDPVLR (SEQ ID NO: 1165)) are shown in bold.

Figure 28:
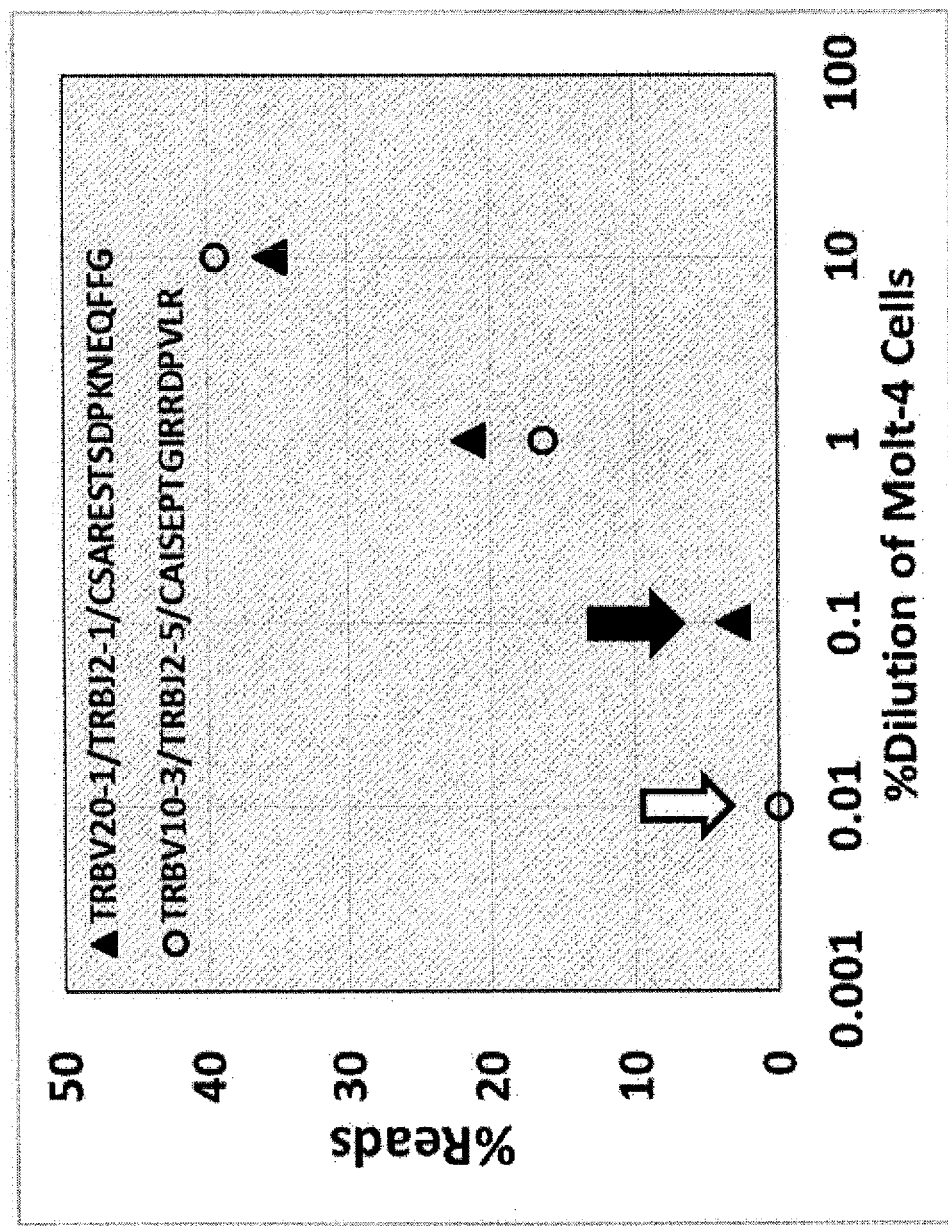
FIG. 28 shows detection sensitivity and the number of TCR reads in a serially diluted Molt-4 cell sample. Two TCR reads were detected from a Molt-4 cell (▲: TRBV20-1/TRBJ2-1/CSARESTSDPKNEQFFG (SEQ ID NO: 1163), (○: TRBV10-3/TRBJ2-5/CAISEPTGIRRDPVLR) (SEQ ID NO: 1164). The figure shows the percentage of TCR reads derived from Molt-4 detected in TCR reads acquired from each of 10%, 1%, 0.1% and 0.01% serially diluted Molt-4 samples. The detection limit for each read was 0.1% (▲) and 0.01% (○).

FIG. 28 shows detection sensitivity and number of TCR reads in a serially diluted Molt-4 cell sample. Two TCR reads were detected from a Molt-4 cell (A: TRBV20-1/TRBJ2-1/CSARESTSDPKNEQFFG (SEQ ID NO: 1166), 0: TRBV10-3/TRBJ2-5/CAISEPTGIRRDPVLR (SEQ ID NO: 1165)). The figure shows the percentage of TCR reads derived from Molt-4 detected in TCR reads acquired from each of 10%, 1%, 0.1% and 0.01% serially diluted Molt-4 samples. The detection limit for each read was 0.1% (▲) and 0.01% (○).

Analytical Test Example

Analytical Test Example 1 BCR Repertoire Analysis on Healthy Individuals

The present Example compared BCR repertoires of healthy individuals.

(Materials and Methods)

(Materials)

A read set was used, which was from sequencing, with a Roche GS-Junior, a cDNA of a BCR unbiasedly obtained from an RNA obtained from one specimen of healthy individual peripheral blood mononuclear cell. The read set is for each class of IgM, IgG, IgA, IgD, and IgE.

(Method)

FIG. 30 shows the overall picture of the method (FIG. 29 shows a TCR analysis scheme).

Previously reported allelic nucleic acid sequences from IMGT were obtained for use as a reference data base. BLASTN was used for homology search while setting the following parameters for each region.

V mismatch penalty=−1, shortest alignment length=30, and shortest kernel length=15;

D word length=7, mismatch penalty=−1, gap penalty=0, shortest alignment length=11, and shortest kernel length=8;

J mismatch penalty=−1, shortest hit length=18, and shortest kernel length=10; and C shortest hit length=30 and shortest kernel length=15. An indicator used for selecting the closest reference allele was applied in the following priority order.

1. number of matching bases, 2. kernel length, 3. score, and 4. alignment length, and then for each class, the frequency of appearance of gene name for each region was calculated and compared with one another. Further, IgG and IgA have subclasses. Thus, comparison was also performed between subclasses.

(Results)

Figure 31:
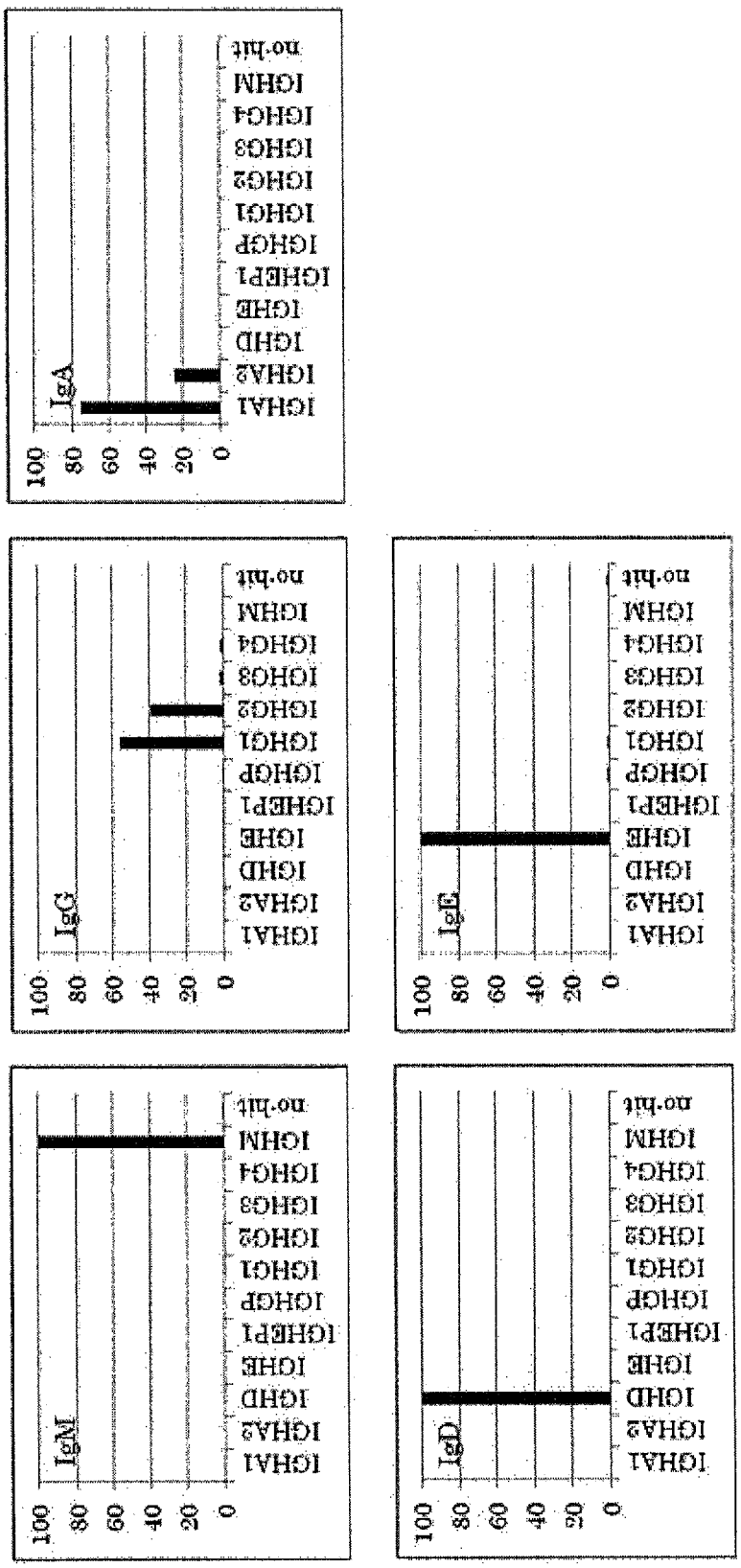
FIG. 31 is a diagram showing the frequency of C for each class. The vertical axis indicates the frequency (%) and the horizontal axis indicates the gene names. No-hit indicates a frequency of genes that do not fall under any gene.

FIG. 31 shows results of deriving out a frequency of appearance of C gene name for each read set of IgM, IgG, IgA, IgD, and IgE. Only the gene name corresponding to each class appeared and hardly any no-hit is observed, suggesting sufficient quality of the read set subjected to analysis.

Figure 32A:
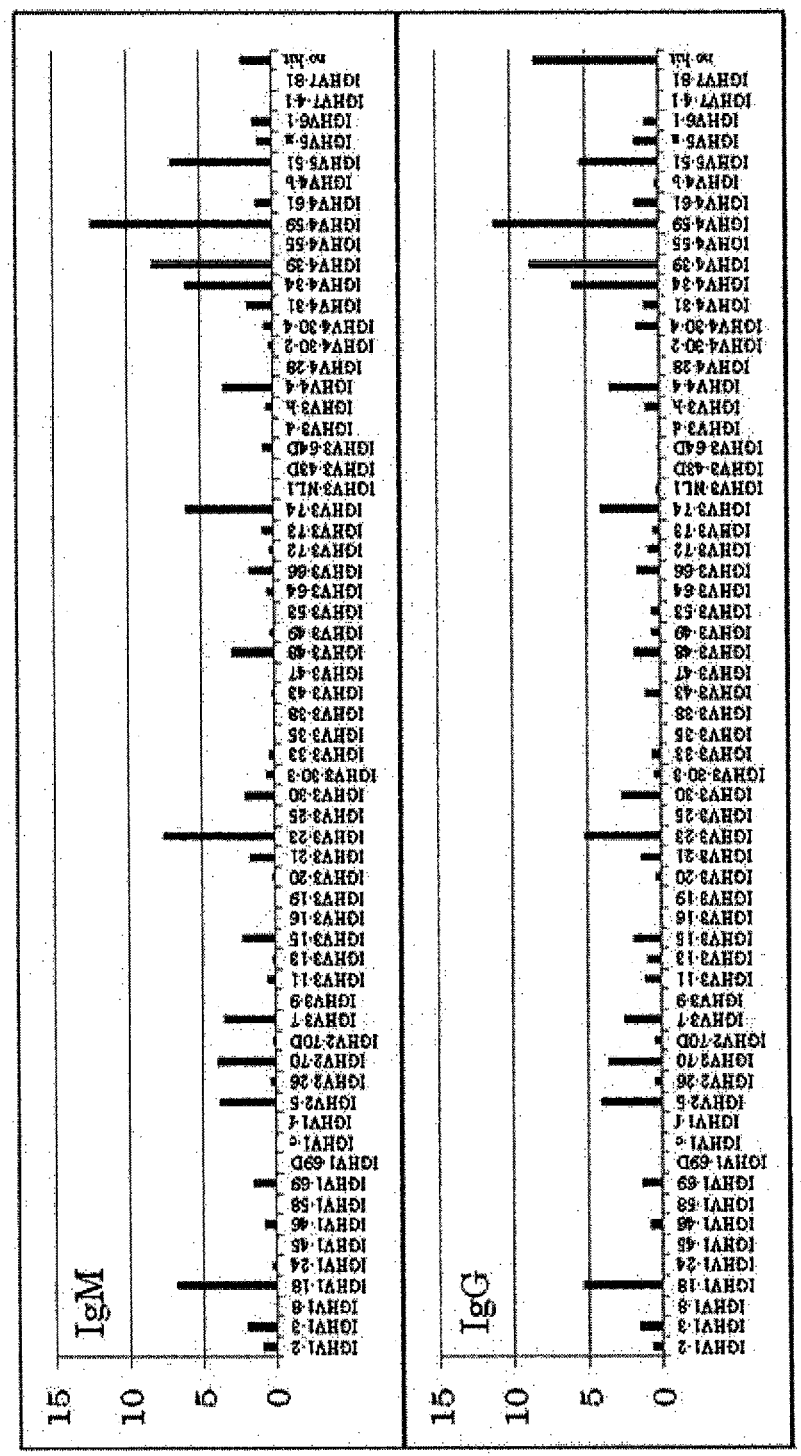
FIG. 32 (A and B) are diagrams showing a comparison of V repertoires among classes. The vertical axis indicates the frequency (%) and the horizontal axis indicates the gene names. No-hit indicates a frequency of genes that do not fall under any gene.
Figure 32B:
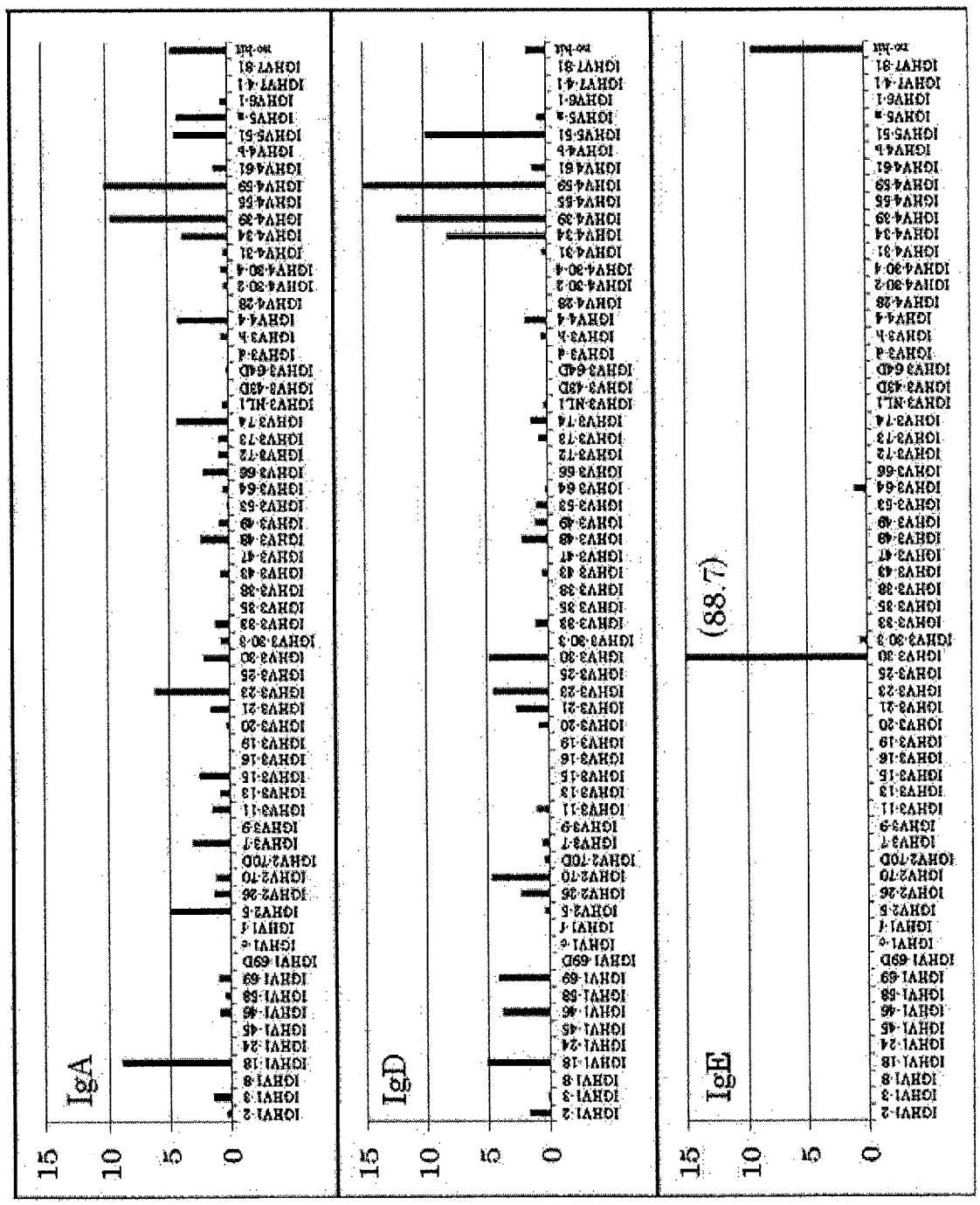
Figure 33:
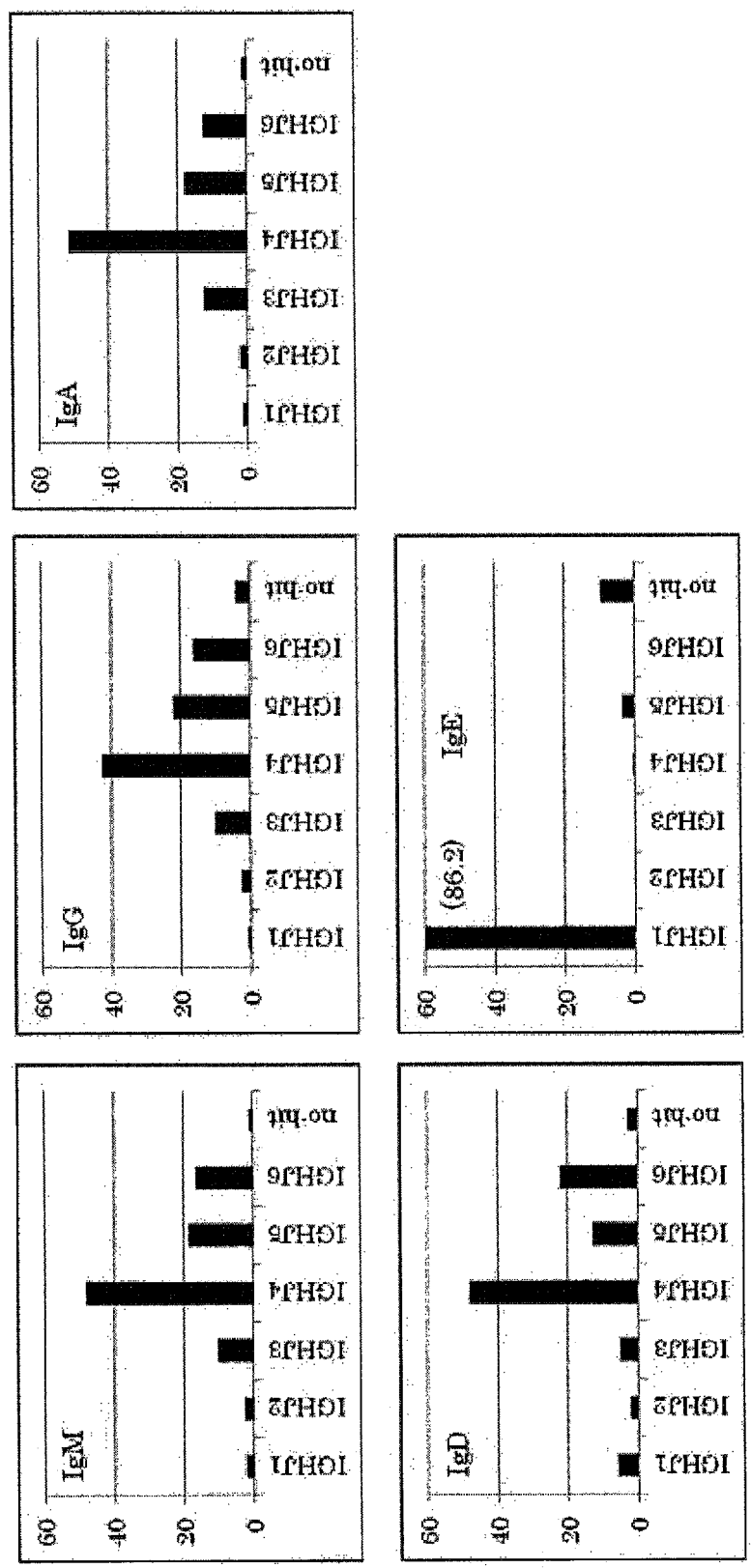
FIG. 33 is a diagram showing a comparison of J repertoires among classes. The vertical axis indicates the frequency (%) and the horizontal axis indicates the gene names. No-hit indicates a frequency of genes that do not fall under any gene.
Figure 34A:
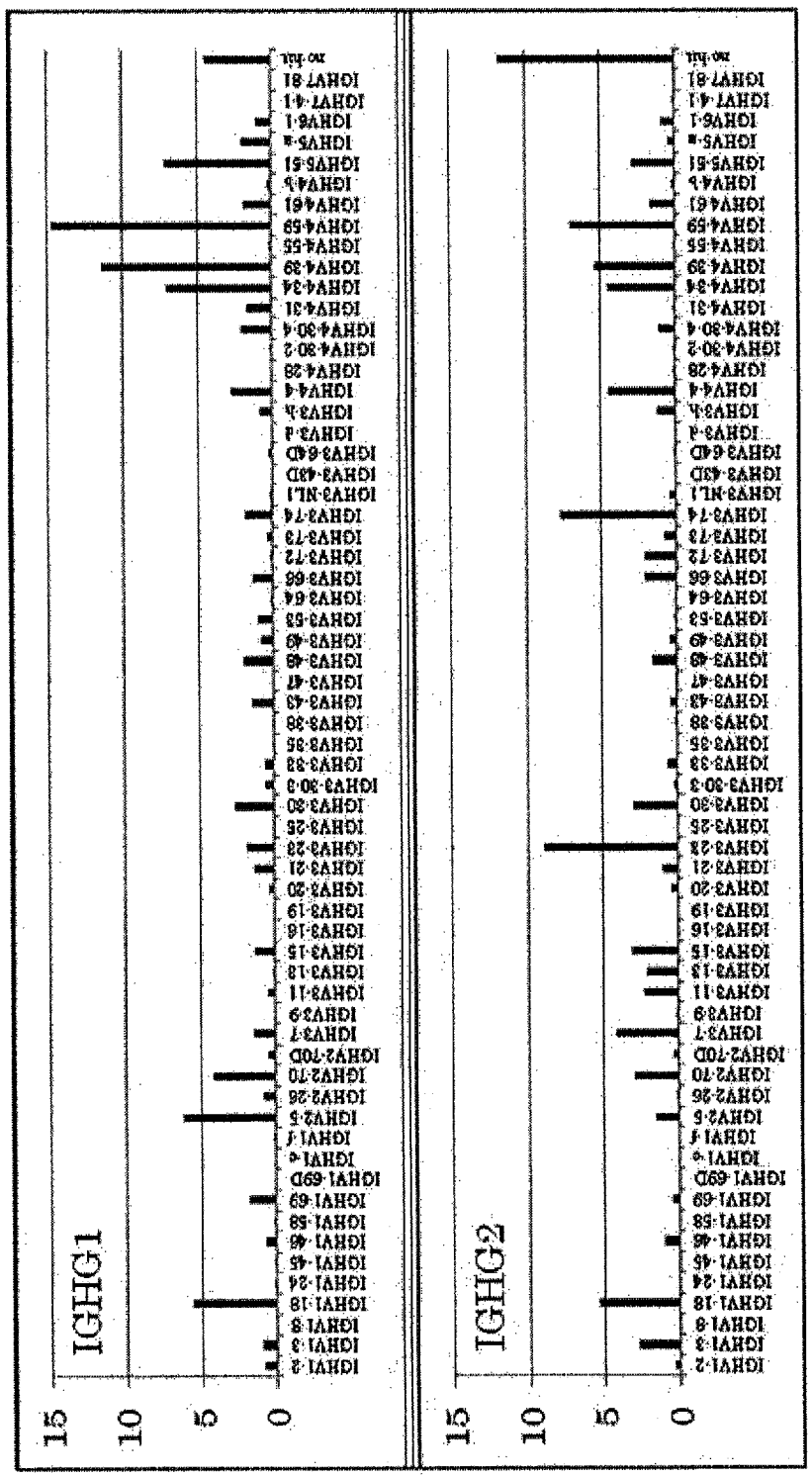
FIG. 34 (A and B) are diagrams showing a comparison of V repertoires among subclasses. The vertical axis indicates the frequency (%) and the horizontal axis indicates the gene names. No-hit indicates a frequency of genes that do not fall under any gene.
Figure 34B:
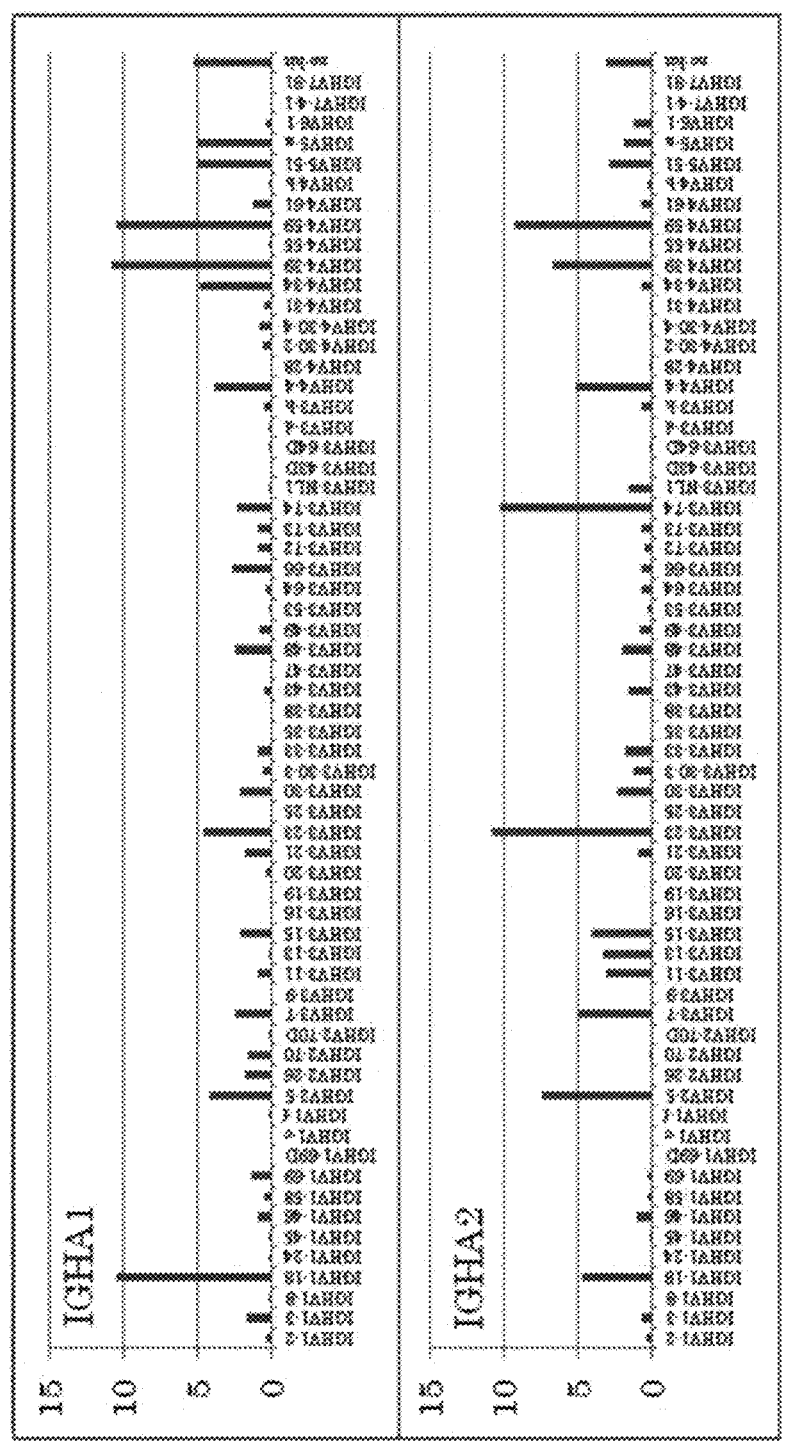
Figure 35:
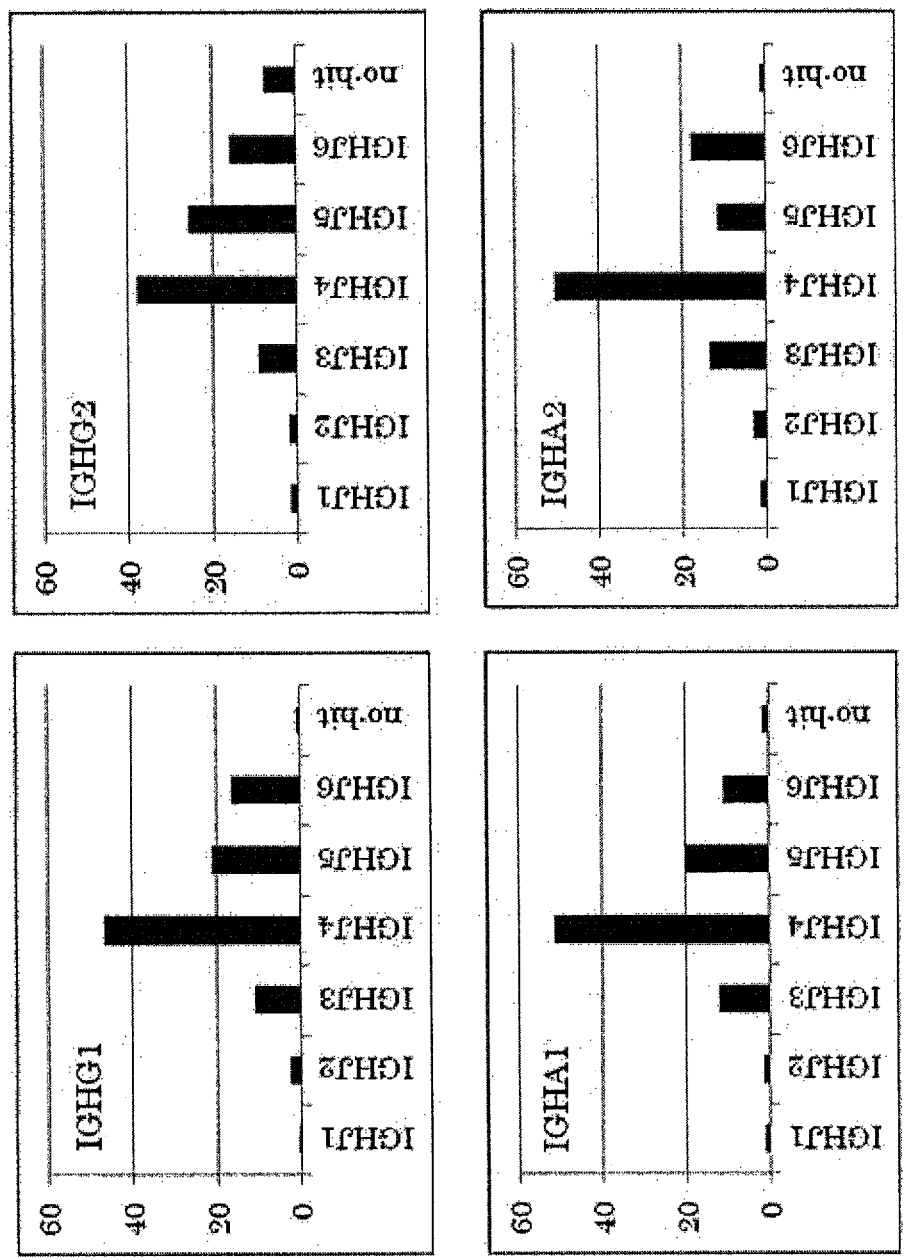
FIG. 35 is a diagram showing a comparison of J repertoires among subclasses. The vertical axis indicates the frequency (%) and the horizontal axis indicates the gene names. No-hit indicates a frequency of genes that do not fall under any gene.

The results of calculating a D repertoire for each class are shown in Tables 2-3 and 2-4. Table 2-3 and Table 2-4 show a comparison of D repertoires among classes. The number of reads appeared is described for each gene name and CDR3 amino acid sequence. The gene name and amino acid sequence with number of reads of 1 were omitted. Further, FIG. 32 (A and B) show a V repertoire and FIG. 33 shows a J repertoire. FIG. 34 (A and B) show a comparison of V repertoires among subclasses. FIG. 35 shows a comparison of J repertoires among subclasses. For D, a frequency is derived out for a combination of a D gene name and CDR3 amino acid sequence.

TABLE 2-3

Comparison of D repertoire among classes,
vertical axis: frequency (%), horizontal axis: gene name

| gene name | num reads | CDR3 amino acids | num reads | SEQ ID NO: |
|---|---|---|---|---|
| IgA | | | | |
| IGHD2-21 | 74 | CAKDMCGLWASCGGDCYSRRTTSLTT | 41 | 61 |
|  |  | CAKDMCGLWASCGGDCYSRRTASLTT | 5 | 62 |
|  |  | CARGPNMAFVVVTAILMLLIS | 4 | 63 |
|  |  | CARAPDCGGSTCYSHPYYGMDVW | 4 | 64 |
|  |  | CARSHIVVVTAIPLEMLLIS | 2 | 65 |
|  |  | CARDPRIVVVAPATHTPTTVWTS | 2 | 66 |
| IGHD6-13 | 41 | CGRSRHSSSWQILTP | 11 | 67 |
|  |  | CANGGLAAAGDHLTT | 5 | 68 |
|  |  | CALCPTPIAAAGSVTT | 5 | 69 |
|  |  | CARAPSIPVAGIGYHFDHW | 3 | 70 |
|  |  | CALCPNPYSSGWFCNYW | 3 | 71 |
|  |  | CARAPSIPVAGIATTLTT | 2 | 72 |
| IGHD3-3 | 37 | CIYDFWSGGPHPTLTT | 11 | 73 |
|  |  | CARIVNTEGFWSGFLTP | 4 | 74 |
|  |  | CTRRGGVVIICLTT | 2 | 75 |
|  |  | CIHTGNDFWTGTNYGLTS | 2 | 76 |
|  |  | CARIVNTEGFGVVFLTP | 2 | 77 |
|  |  | CAKDRFSGRGRFEFMEWLTPLTT | 2 | 78 |
|  |  | CAKDRFSEGKVQFMEWLTPLTT | 2 | 79 |
| IGHD3-22 | 36 | CARRPIPPLTMRVVVIPLTS | 5 | 80 |
|  |  | CARDPPMPMIVVQTLTT | 2 | 81 |
|  |  | CARDPPMPMILVQTLTT | 2 | 82 |
|  |  | CAKILITMILVVSLMLLIS | 2 | 83 |
| IGHD3-10 | 33 | CAREIRGTTMVRELTTSTATWTP | 6 | 84 |
|  |  | CVRTYYFGLGDIITEITSTVWTS | 3 | 85 |
|  |  | CATYYYGSGSAGHNFDYW | 2 | 86 |
|  |  | CARRTYYGSTNLTT | 2 | 87 |
|  |  | CARMVTDYYGSGNRGWFDPW | 2 | 88 |
|  |  | CARGPGLSVMIRGVITTPNHILIT | 2 | 89 |
|  |  | CARDYYGSGVMTL | 2 | 90 |

TABLE 2-3-continued

Comparison of D repertoire among classes,
vertical axis: frequency (%), horizontal axis: gene name

| gene name | num reads | CDR3 amino acids | num reads | SEQ ID NO: |
|---|---|---|---|---|
| IGHD2-15 | 29 | CARAPDCGGGTCYSHPTTVWTS | 5 | 91 |
|  |  | CARARIVVVPATLTPTTVWTS | 3 | 92 |
|  |  | CARAPDCGGGTCYSHPYYGMDVW | 3 | 93 |
|  |  | CAKDLAPLKSCSRGGCYPYYYGLDIW | 3 | 94 |
| IGHD1-26 | 22 | CARGPATAILGATPSLTP | 3 | 95 |
|  |  | CARDDSASYSRGTT | 3 | 96 |
|  |  | CVRHDYSDNDLSTNWFGP | 2 | 97 |
| IGHD5-5 | 19 | CMGPGDTAI | 7 | 98 |
|  |  | CARRPREMESAMVLSLTT | 2 | 99 |
| IGHD3-9 | 19 | CAHSAPYYDILSRNRARSWKDFDNW | 3 | 100 |
|  |  | CAHSAPIMIFCLVTAHEVGRILTT | 3 | 101 |
|  |  | CATVALLRYFDWSSTR | 2 | 102 |
| IGHD6-19 | 14 | CARGRRSLPAIVYSSGPDRPNWFDPW | 6 | 103 |
|  |  | CTSAAVASSSGWPLRGVWTS | 3 | 104 |
| IGHD2-2 | 14 | CARAPLCSSASCHLQLDYW | 5 | 105 |
| IGHD4-23 | 11 | CARGAGYGGNSGVRTT | 9 | 106 |
| IGHD4-17 | 10 | CARTLYGDFVDF | 2 | 107 |
| IGHD3-16 | 9 | CAKGVLSSGGVIATLPGSTP | 3 | 108 |
|  |  | CARGFGARGVILT | 2 | 109 |
| IGHD2-8 | 8 | CANVGGADRNYCINGVRHNPNYLTT | 5 | 110 |
| IGHD6-6 | 5 |  |  |  |
| IGHD5-12 | 5 | CARHVNGYDYLFPFTSW | 3 | 111 |
| IGHD1-1 | 3 | CARGGSQLERRRPLVTT | 3 | 112 |
| IGHD5-24 | 2 |  |  |  |
| (unidentified) | 662 | CARETVGGTLTT | 19 | 113 |
|  |  | CARISSGHDPPIITGWTS | 13 | 114 |
|  |  | CAKGHQVRLRGRTGTSIS | 11 | 115 |
|  |  | CARSPIWFGSHRFTTTWRS | 9 | 116 |
|  |  | CARDPLETGATSLII | 9 | 117 |
|  |  | CAKLGNRPGFTEWDHWFGPW | 9 | 118 |
|  |  | CAGAPDCGVGAAPLTSTTVCTS | 8 | 119 |
|  |  | CVRDPHETGATTLIT | 6 | 120 |
|  |  | CARIRKEVGAPPITWTS | 6 | 121 |
|  |  | CARGSWSGAAFYSLTT | 6 | 122 |
|  |  | CARDPNKFRTNHLSTT | 6 | 123 |
|  |  | CAGIGGATSTTTTTWTS | 6 | 124 |
|  |  | CATVPELTDISLPRLMALIS | 5 | 125 |
|  |  | CARVWGKHTLTT | 5 | 126 |
|  |  | CARRAAPHDYGHVLIF | 5 | 127 |
|  |  | CARDPNKFRPNHLSTT | 5 | 128 |
|  |  | CARAGRELLRALMTT | 5 | 129 |
|  |  | CARAGAELLRALMTT | 5 | 130 |
|  |  | CARAEDYYDTEGYFYLTP | 5 | 131 |
|  |  | CAHRTNYSTNRYGAFTTLTS | 5 | 132 |
|  |  | CVRHDGSFTKTGSTP | 4 | 133 |
|  |  | CVRDPQETGATTLIT | 4 | 134 |
|  |  | CVKIGAAH | 4 | 135 |
|  |  | CATQCLGGAGLTTTTAPWTS | 4 | 136 |
|  |  | CARRTYYSGSTNLTT | 4 | 137 |
|  |  | CARRTTRETGSSIS | 4 | 138 |
|  |  | CARLRCSNDNCAGHLYYYFSGLDIW | 4 | 139 |
|  |  | CARASLPRGLLIS | 4 | 140 |
|  |  | CAKGRGRRAAGKFLTT | 4 | 141 |
|  |  | CVRQYGLGSGSLTP | 3 | 142 |
|  |  | CVKIRNLIGFTGSTP | 3 | 143 |
|  |  | CTRDGVRGDLNPTLNV | 3 | 144 |
|  |  | CTKGGGRKTAGKFLTP | 3 | 145 |
|  |  | CDKAKVTADLRT | 3 | 146 |
|  |  | CATVPELPDISLPRLMALIS | 3 | 147 |
|  |  | CATVFGRRYRLLTT | 3 | 148 |

TABLE 2-3-continued

Comparison of D repertoire among classes,
vertical axis: frequency (%), horizontal axis: gene name

| gene name | num reads | CDR3 amino acids | num reads | SEQ ID NO: |
|---|---|---|---|---|
| | | CARYRAAYPRRAWTS | 3 | 149 |
| | | CARTIGFEIAMTGGLGALTP | 3 | 150 |
| | | CARTARTGDL | 3 | 151 |
| | | CARRDPPVRASLSTTLTS | 3 | 152 |
| | | CARIGHEFYSLTYSVNDVFDLW | 3 | 153 |
| | | CARFQRYCRGGSCSATLDAFDKW | 3 | 154 |
| | | CARDLGERRDGEPTNWFDAW | 3 | 155 |
| | | CARDLAVWATLTT | 3 | 156 |
| | | CAKGAGRRAAGKFLTT | 3 | 157 |
| | | CAKDVEPTVTLYNHFDP | 3 | 158 |
| | | CAKDFNWEGIT | 3 | 159 |
| | | CAHRTNYSTNRYGGLYYFDFW | 3 | 160 |
| | | CVRGVGTILWLTI | 2 | 161 |
| | | CVRFIGAYSNNWYPGYFDYW | 2 | 162 |
| | | CVRDAGPGGSLTS | 2 | 163 |
| | | CTTGFSGSTACHWDHTACHWDDAFAMW | 2 | 164 |
| | | CTHAVESLLGTTSTS | 2 | 165 |
| | | CIHTGNDFGPGPTMVWTS | 2 | 166 |
| | | GGVGRGDNDVDFKFKW | 2 | 167 |
| | | CATRESPLTI | 2 | 168 |
| | | CATAGIELWRAGSTP | 2 | 169 |
| | | CASQSQNYYYYYMDVW | 2 | 170 |
| | | CASKKEILWAGPNLTT | 2 | 171 |
| | | CARYRIAMATSPYFDWY | 2 | 172 |
| | | CARVRCGLVASEGVLIS | 2 | 173 |
| | | CARTNFGSGGYILGDTTMVWTS | 2 | 174 |
| | | CARSAGYLHRRTS | 2 | 175 |
| | | CARRTYYSGSTNFDYW | 2 | 176 |
| | | CARRDLPFGASLSTTLTS | 2 | 177 |
| | | CARRAAPMTGMFLIF | 2 | 178 |
| | | CARPGFSYGPRLTP | 2 | 179 |
| | | CARLRGGFPPVVKRVEVFLLTS | 2 | 180 |
| | | CARKKIPTAGYSSLTT | 2 | 181 |
| | | CARGSWMGRPFISLTT | 2 | 182 |
| | | CARGRFARGGDDSLIS | 2 | 183 |
| | | CARGLRWADN | 2 | 184 |
| | | CARGGTSGLILDTTSTPWTS | 2 | 185 |
| | | CAREMHIDSLTVGRAFDIW | 2 | 186 |
| | | CARDVPDIYSSGATDC | 2 | 187 |
| | | CARDPSYLPTPALKT | 2 | 188 |
| | | CARDPNKFRPNHFVDYW | 2 | 189 |
| | | CARDLGTTNYWLDTW | 2 | 190 |
| | | CAKQRASGNSLTI | 2 | 191 |
| | | CAKEPKIVGRRRTTLIT | 2 | 192 |
| | | CAKDLGVCSEGAASSLVLIS | 2 | 193 |
| | | CAKAPGDLCRSTP | 2 | 194 |
| | | CAHSAPYYDICLVTAHEVGRILTT | 2 | 195 |
| | | CAGLIGRFIPLTT | 2 | 196 |
| | | CAGIRGSNIYYHYYYMDVW | 2 | 197 |
| | | CADLPGIIGGEIT | 2 | 198 |
| IgD | | | | |
| IGHD3-22 | 432 | CARHDTPRVYYDSSGYYYGVDYFDYW | 168 | 199 |
| | | CASMDTKNYYDSSGSQPRRSYYFDYW | 39 | 200 |
| | | CAQYYYDSSGYYYYYGMDVW | 25 | 201 |
| | | CARISYYYDSSGYYYRDW | 21 | 202 |
| | | CARVRGITMIVVVTTLTT | 17 | 203 |
| | | CASMDTKNYYDSSGSQPGGRTTLTT | 7 | 204 |
| | | CASMDTKITMIVVVPNPGGRTTLTT | 7 | 205 |
| | | CARYNYTIVVGP | 5 | 206 |
| | | CARISYYYDSSGYYTVT | 5 | 207 |
| | | CARIRYYYDSSGYYYFDYW | 4 | 208 |
| | | CARHVRDGMIVVAEIDYW | 4 | 209 |
| | | CARVAVRSYYPFGMDVW | 3 | 210 |
| | | CARLPLDSSGYYLTT | 3 | 211 |
| | | CARLPLDSSGYYFDYW | 3 | 212 |
| | | CASMDTKNYYDSSGSQPRRSHYFDYW | 2 | 213 |
| | | CARYRITMIVVVITTVT | 2 | 214 |
| | | CARYNYYDSSGSW | 2 | 215 |
| | | CARVRGYYDSMSMSALLMS | 2 | 216 |
| | | CARVRGTMIVVSMSALLMS | 2 | 217 |
| | | CARVRGNYYDSSGYYFDYW | 2 | 218 |
| | | CARSGRVGARPKLYYW | 2 | 219 |

TABLE 2-3-continued

Comparison of D repertoire among classes,
vertical axis: frequency (%), horizontal axis: gene name

| gene name | num reads | CDR3 amino acids | num reads | SEQ ID NO: |
|---|---|---|---|---|
| | | CARISYYYDVVVITTVT | 2 | 220 |
| | | CARHVRDGMIVVAEMTT | 2 | 221 |
| | | CARHDTPRAYYDSSGYYYGVDYFDYW | 2 | 222 |
| | | CAREFFGTRTMIVVVTYFDYW | 2 | 223 |
| | | CAQYYYDSMVITTTTVWTS | 2 | 224 |
| IGHD3-10 | 217 | CARGVRGVIINTFTTLTT | 118 | 225 |
| | | CTWFGEATTTVWTS | 25 | 226 |
| | | CARGGSGVIINTFTTLTT | 10 | 227 |
| | | CARCAGGSGSYYYYYMEVW | 9 | 228 |
| | | CVKAGFGELLIGGDRTT | 6 | 229 |
| | | CARGGSGSYYKHVYYFDYW | 6 | 230 |
| | | CARCAGGSGVTTTTTWRS | 6 | 231 |
| | | CTWFGGGYYYGMDVW | 5 | 232 |
| | | CTWFGGATTTVWTS | 3 | 233 |
| | | CARLDGSGRRGTALTT | 3 | 234 |
| | | CARLDVRGGRGTALTT | 2 | 235 |
| | | CARGGSGVIINTFTTLTM | 2 | 236 |
| | | CARCAGVRGVTTTTTWRS | 2 | 237 |
| IGHD3-16 | 169 | CARRVMITFGELSSTTLTT | 140 | 238 |
| | | CARRVMITFGGVIVTTLTM | 3 | 239 |
| | | CARRVMITFGGVIVDYFDYW | 3 | 240 |
| | | CARRVMITFGGVIVDTLTT | 3 | 241 |
| | | CANPTSFRQCSMTT | 3 | 242 |
| | | CARRVMITLGELSSTTLTT | 2 | 243 |
| | | CARRAMITFGELSSTTLTT | 2 | 244 |
| IGHD6-19 | 134 | CARHGIAVAYYFDYW | 28 | 245 |
| | | CARVSSGWSGGNPAPATLTT | 22 | 246 |
| | | CARHVGSGWVYFDYW | 12 | 247 |
| | | CARRDDSSGWYGHDYW | 11 | 248 |
| | | CARGYSSGFGDALIP | 8 | 249 |
| | | CARVSSGWSGVTPAPATLTT | 7 | 250 |
| | | CARRDDSMAGTAMTT | 4 | 251 |
| | | CARGYSSGFGDAFDTW | 4 | 252 |
| | | CARGIRYSSGWYGSNWFDPW | 4 | 253 |
| | | CARRDDSSGWYGHDY | 3 | 254 |
| | | CARRDDSSAGTAMTT | 3 | 255 |
| | | CARHGIAWPTTLTT | 3 | 256 |
| | | CARHVGSGWVTLTT | 2 | 257 |
| | | CARHGIAVAYYLTT | 2 | 258 |
| IGHD5-5 | 122 | CARAGGYSYGYLLPLMLLIS | 29 | 259 |
| | | CARRKRELLWVTTTTTTWTS | 20 | 260 |
| | | CARQKSATVWTS | 17 | 261 |
| | | CARVNLEQLWYRRGTTTTVWTS | 8 | 262 |
| | | CARVNLEQLCTGRGTTTTVWTS | 7 | 263 |
| | | CARFYNRRMLSTAMVDIDYW | 5 | 264 |
| | | CARVNLEQLWYRTGYYYYGMDVW | 4 | 265 |
| | | CARLFNYAREYGMDVW | 4 | 266 |
| | | CARVNLEQLWYRTGSTTTVWTS | 2 | 267 |
| | | CARVAPRLTT | 2 | 268 |
| | | CARLFNYARGVRVWTS | 2 | 269 |
| IGHD1-26 | 85 | CARHVGSGWVYFDYW | 16 | 270 |
| | | CARAQYSGATECKGTLTT | 10 | 271 |
| | | CARHSLTPGFLLNYFDYW | 8 | 272 |
| | | CTRSRGLSGTYYNPDNDYW | 7 | 273 |
| | | CARAQYSGSYRMQRYFDYW | 7 | 274 |
| | | CARHVKVLGATVGFDYW | 3 | 275 |
| | | CARAQYSGSYRCKGTLTT | 3 | 276 |
| | | CTRSRGLSGTTTIQIMTT | 2 | 277 |
| | | CARPSIVGATECKGTLTT | 2 | 278 |
| | | CARHVAVAGSTLTT | 2 | 279 |
| | | CARAQYSGSYRMQRYLTT | 2 | 280 |
| | | CARAQYSGSYRMQGTLTT | 2 | 281 |
| | | CAHTHRSVGATA | 2 | 282 |
| IGHD6-13 | 73 | CAKVTHAYSSTWYHGDYYYGMDVW | 28 | 283 |
| | | CARGHLPYSSTDKGHWFDPW | 16 | 284 |
| | | CARDSSHGYSSSWPDYW | 4 | 285 |
| | | CAKLPMRIAAPGTMGTTTTTVWTS | 3 | 286 |
| | | CARDSSTGIAAAGPTT | 2 | 287 |

TABLE 2-3-continued

Comparison of D repertoire among classes,
vertical axis: frequency (%), horizontal axis: gene name

| gene name | num reads | CDR3 amino acids | num reads | SEQ ID NO: |
|---|---|---|---|---|
| IGHD2-15 | 46 | CLASRPLWFGDPNGSTP | 5 | 288 |
| | | CAKDSSRYCSGGSCKYFDYW | 4 | 289 |
| | | CAKNPASTGYGSFDYW | 3 | 290 |
| | | CAKIRPVLVTEALTI | 3 | 291 |
| | | CAKDSSRYCMVVAANTLTT | 3 | 292 |
| | | CARLILGYCSGVGCTPT | 2 | 293 |
| | | CARDRGSGGSCYVLTT | 2 | 294 |
| | | CARDGVVVVLLLLTT | 2 | 295 |
| | | CANWARVVVASGTTTTWTS | 2 | 296 |
| | | CAKNPPVLVTEALTI | 2 | 297 |
| | | CAKNPAVLVTEALTI | 2 | 298 |
| IGHD3-3 | 25 | CASKKKFLEWPETTTTTVWTS | 6 | 299 |
| | | CARKEFLEWPETTTTTVWTS | 5 | 300 |
| | | CAKDINPDYDFWSGSHLPYDAFDIW | 5 | 301 |
| | | CARKKNFLEWPETTTTTVWTS | 2 | 302 |
| | | CAKDINPDYDFWSGSHLPYDALIS | 2 | 303 |
| IGHD2-2 | 18 | CARDARYCSSTSCYSFPYWYFDLW | 2 | 304 |
| | | CARDARYCSSTSCYSFPTGTSIS | 2 | 305 |
| | | CARDARYCSSTSCYRFPYWYFDLW | 2 | 306 |
| IGHD5-12 | 15 | CARRLGRVATTYYMDVW | 5 | 307 |
| | | CARRLVEWLRPTTWTS | 3 | 308 |
| | | CARRVGVEWLRPTTWTS | 2 | 309 |
| IGHD2-8 | 13 | CTRDIVLTTPREWYFDLW | 5 | 310 |
| | | CTRDIVLTTPGSGTSIS | 3 | 311 |
| IGHD4-17 | 5 | CARDLIYGDYPTTTWTS | 4 | 312 |
| (unidentified) | 989 | CARGAAPGVETGSTP | 264 | 313 |
| | | CARHTLFSDSSAPPRGVYYYYYMDVW | 60 | 314 |
| | | CARGATVGVETGSTP | 52 | 315 |
| | | CANWAGVTGTVPLTT | 41 | 316 |
| | | CARQKSATVWTS | 33 | 317 |
| | | CARAGIQLEVFTLTT | 21 | 318 |
| | | CARLDGSGGRGTALTT | 20 | 319 |
| | | CARRKRELLWVTTTTTTWTS | 19 | 320 |
| | | CANPDLISAMFDDYW | 14 | 321 |
| | | CARHQCSGEACFYYYGMDVW | 13 | 322 |
| | | CANPTSFRQCSMTT | 12 | 323 |
| | | CARGGTIPFPWTS | 9 | 324 |
| | | CARAQGGAHTTLTT | 9 | 325 |
| | | CTRDTGSSAGATDLW | 8 | 326 |
| | | CAKAVAVTGSHFDYW | 8 | 327 |
| | | CARGAAPGVETGSTL | 7 | 328 |
| | | CARAQGRGTYYFDYW | 7 | 329 |
| | | CARAIIRYFND | 7 | 330 |
| | | CAIPPDGSRRSPLTT | 7 | 331 |
| | | CVREGFCGAHGCYSLTYW | 6 | 332 |
| | | CARHILFSDSSAPPRGSTTTTTWTS | 6 | 333 |
| | | CARGYSSASVMLLIP | 6 | 334 |
| | | CVREGFVVLMAVILLPT | 5 | 335 |
| | | CARSGPRGLTT | 5 | 336 |
| | | CARHSLTPGFLLNYFDYW | 5 | 337 |
| | | CARGWELDRW | 5 | 338 |
| | | CARDPSSLYYYYGMDVW | 5 | 339 |
| | | CARAHHISMT | 5 | 340 |
| | | CANPDSFRQCSMTT | 5 | 341 |
| | | CAIPRTEGRRSPLTT | 5 | 342 |
| | | CARTFGDSAALIS | 4 | 343 |
| | | CARLFNYAREYGMDVW | 4 | 344 |
| | | CARHTLFSDSSAPPTGGLLLLLHGRL | 4 | 345 |
| | | CARHTLFRIVVPLPGGSTTTTTWTS | 4 | 346 |
| | | CARDLGESSSTTLTT | 4 | 347 |
| | | CARAIIRYFNDW | 4 | 348 |
| | | CAPGGLRLGVETGSTP | 4 | 349 |
| | | CARTLDYGIATGSIIMVWTS | 3 | 350 |
| | | CARRLGRVARPTTWTS | 3 | 351 |
| | | CARLFNTPGSTVWTS | 3 | 352 |
| | | CAIPPTEGRRSPLTT | 3 | 353 |
| | | CAIPPDGRQTVPFDYW | 3 | 354 |

TABLE 2-3-continued

Comparison of D repertoire among classes,
vertical axis: frequency (%), horizontal axis: gene name

| gene name | num reads | CDR3 amino acids | num reads | SEQ ID NO: |
|---|---|---|---|---|
| | | CTRDTGSPPEPLTS | 2 | 355 |
| | | CATSRGGRGTT | 2 | 356 |
| | | CATSGGVGDY | 2 | 357 |
| | | CATPTSFRQCSMTT | 2 | 358 |
| | | CATAAGLWSSSTTWTS | 2 | 359 |
| | | CATAAGLWSSKYYMDVW | 2 | 360 |
| | | CASKKSATVWTS | 2 | 361 |
| | | CARVGSSTMLLIS | 2 | 362 |
| | | CARVGSSPMLLIS | 2 | 363 |
| | | CARVAARPMLLIS | 2 | 364 |
| | | CARTFVIRLLLIS | 2 | 365 |
| | | CARRLGRVLRPTTWTS | 2 | 366 |
| | | CARRKKGSCYRVTTTTTTWTS | 2 | 367 |
| | | CARLFNYARSTVWTS | 2 | 368 |
| | | CARHVGMAGSTLTT | 2 | 369 |
| | | CARHTLFSDSSAPPRGGLLLLLHGRL | 2 | 370 |
| | | CARHTLFSDSSALPRGVYYYYMDVW | 2 | 371 |
| | | CARHTLFSDSSALPGGSTTTTWTS | 2 | 372 |
| | | CARHQCSGEACFYYTAWTS | 2 | 373 |
| | | CARGYSMASVMLLIP | 2 | 374 |
| | | CARGWELDR | 2 | 375 |
| | | CARGQMGATTLIDYW | 2 | 376 |
| | | CAREWPTGTRGMC | 2 | 377 |
| | | CAREWPTGTRGMC | 2 | 378 |
| | | CAREWPTGNQRGCG | 2 | 379 |
| | | CARDSTQTT | 2 | 380 |
| | | CARAQYGGATECKGTLTT | 2 | 381 |
| | | CARAQGAGAHTTLTT | 2 | 382 |
| | | CARAKYDISMT | 2 | 383 |
| | | CARAIYDISMT | 2 | 384 |
| | | CARAHRYSMT | 2 | 385 |
| | | CARAHGAGAHTTLTT | 2 | 386 |
| | | CANWPGVTGTVPLTT | 2 | 387 |
| | | CAKRWGSSSWTT | 2 | 388 |
| | | CAKIRPVLVTEALTI | 2 | 389 |
| | | CAKDLHSYGYLGAFDIW | 2 | 390 |
| | | CAIPPDGRQTSPLTT | 2 | 391 |
| | | CAIPPDGRQTAPLTT | 2 | 392 |
| | | CAHTHRSVGALP | 2 | 393 |
| | | CAGVAPRLTT | 2 | 394 |
| IgE | | | | |
| IGHD4-17 | 3475 | CARGFDGGWEHW | 3103 | 395 |
| | | CARGFLMVAGEHW | 113 | 396 |
| | | CARGFLMVAGST | 25 | 397 |
| | | CARGFDGGWGAL | 21 | 398 |
| | | CARGFDGGWEH | 17 | 399 |
| | | CARGFDGAGST | 12 | 400 |
| | | CARGFDGGWEYW | 10 | 401 |
| | | CARGFDGGWEHR | 10 | 402 |
| | | CAGGFDGGWEHW | 9 | 403 |
| | | CARGLMVAGST | 8 | 404 |
| | | CARGFDGGWST | 8 | 405 |
| | | CARGFDGGREHW | 8 | 406 |
| | | CVRGFDGGWEHW | 7 | 407 |
| | | CARGLDGGWEHW | 7 | 408 |
| | | CARGFDGGWGHW | 7 | 409 |
| | | CARGFDGGWGALG | 6 | 410 |
| | | CARGFDGAGEHW | 6 | 411 |
| | | CARGSDGGWEHW | 5 | 412 |
| | | CARGFGGGWEHW | 5 | 413 |
| | | CARGFDGSWEHW | 5 | 414 |
| | | CARGFDGGWERW | 5 | 415 |
| | | CARGFDDGWEHW | 5 | 416 |
| | | YARGFDGGWEHW | 4 | 417 |
| | | CARGFDGGWKHW | 4 | 418 |
| | | CARGFDGGSGAL | 4 | 419 |
| | | CARGFVWWLGGT | 3 | 420 |
| | | CARGFDSGWEHW | 3 | 421 |
| | | CARGFDRWLGAL | 3 | 422 |
| | | CARGFDGGWVHW | 3 | 423 |
| | | CARGFDGGWEAL | 3 | 424 |
| | | CARGFDGDWEHW | 3 | 425 |

TABLE 2-3-continued

Comparison of D repertoire among classes,
vertical axis: frequency (%), horizontal axis: gene name

| gene name | num reads | CDR3 amino acids | num reads | SEQ ID NO: |
|---|---|---|---|---|
| | | CARGFDGAGSM | 3 | 426 |
| | | CARSFDGGWEHW | 2 | 427 |
| | | CARGFLMVAGEHG | 2 | 428 |
| | | CARGFLMVAGEH | 2 | 429 |
| | | CARGFDVAGST | 2 | 430 |
| | | CARGFDGGWEHS | 2 | 431 |
| | | CARGFDGGWEHG | 2 | 432 |
| | | CARGFDGGCEHW | 2 | 433 |
| | | CARGFDGAGEH | 2 | 434 |
| IGHD1-7 | 3 | CARGFDGGWEHW | 3 | 435 |
| (unidentified) | 166 | CARGFDGGWEHW | 124 | 436 |
| | | CARGFLMVAGEHW | 14 | 437 |
| | | CARGFDGGWEHS | 5 | 438 |
| | | CARGFLMVAGST | 4 | 439 |
| | | CARGFVWWLGGT | 2 | 440 |
| | | CARGFLMVAGSTG | 2 | 441 |
| | | CARGFDGGSGAL | 2 | 442 |
| | | CARGFDGAGST | 2 | 443 |

IgG

| gene name | num reads | CDR3 amino acids | num reads | SEQ ID NO: |
|---|---|---|---|---|
| IGHD3-10 | 60 | CARGRYAGGVHTALTP | 13 | 444 |
| | | CARLPRMVRGNWFHP | 8 | 445 |
| | | CARGAWAVRGVISWAGSTP | 6 | 446 |
| | | CSREVGRDYYGSGVIEITWTS | 4 | 447 |
| | | CAGSGSGSLLTTVWTP | 4 | 448 |
| | | CSREVGRDYYGSGSYRNYMDVW | 3 | 449 |
| | | CVSITNSLLWFGELLIFDCW | 2 | 450 |
| IGHD3-22 | 59 | CAKITSMIVVLIPTMMLLMS | 20 | 451 |
| | | CARGSRARFSSDTSGYQYFDYW | 4 | 452 |
| | | CARGVYLYYDSHAYSVLTT | 3 | 453 |
| | | CARVNYYDSVVLTT | 2 | 454 |
| | | CARVNYYDSSRIDYW | 2 | 455 |
| | | CARLPPFNNDDSSSYALYLTT | 2 | 456 |
| | | CARHSNYYYDTSGYRVLDAFDIW | 2 | 457 |
| | | CARGGMDSYGFYVGHYDYW | 2 | 458 |
| | | CARDPDF | 2 | 459 |
| | | CAKITSMIVVLTPTMMLMS | 2 | 460 |
| IGHD6-13 | 34 | CTRQEESSAAGTGGTSSP | 7 | 461 |
| | | CALCPTPIAAAGSVTT | 7 | 462 |
| | | CATSEGDPVAAAGTKSTKSWFDSW | 3 | 463 |
| | | CARLALLYGSSRYGATLTT | 2 | 464 |
| | | CARGPSSTWYSFDYW | 2 | 465 |
| IGHD2-15 | 31 | CAKKEFILVVVITMMSLLMS | 6 | 466 |
| | | CAKDMTAKACSDYW | 3 | 467 |
| | | CARVMGCRGGRCDFRAFDIW | 2 | 468 |
| | | CARRFCSGGICYFLTT | 2 | 469 |
| | | CALTGLNGRSCYSELLIS | 2 | 470 |
| | | CAKEGVYFSGGNHYDVAFNVW | 2 | 471 |
| IGHD3-3 | 28 | CARPSRCCYSGGGRLTL | 4 | 472 |
| | | CAHSVGFILDFWSGYQNNWFDPW | 4 | 473 |
| | | CARPSRCCYVRGGRLTL | 2 | 474 |
| | | CAMGPTIFGVVFLGSLTS | 2 | 475 |
| | | CAHSVGFILDFWSGYQNNWFDPG | 2 | 476 |
| | | CAHSVGFILDFGVVIRTTGSTP | 2 | 477 |
| IGHD6-25 | 21 | CARVKGGIAGMAWTS | 19 | 478 |
| IGHD5-5 | 21 | CARGVDTTMVRSTTLTT | 7 | 479 |
| | | CARQDPYCSTSNCTMGGAMTLTT | 5 | 480 |
| IGHD5-24 | 21 | CARTDGIRDGYNLHRVLTT | 2 | 481 |
| | | CARTDAIRDGYNLHRVFDYW | 2 | 482 |
| | | CARGKRDAYNYYSHLDSW | 2 | 483 |
| | | CARGKEMPTITTLILTP | 2 | 484 |
| IGHD3-16 | 19 | CVRQSPLDDVWGVFAPVGSTP | 11 | 485 |
| | | CVRQSPLDDVWGVFAPVGSTL | 2 | 486 |

TABLE 2-3-continued

Comparison of D repertoire among classes,
vertical axis: frequency (%), horizontal axis: gene name

| gene name | num reads | CDR3 amino acids | num reads | SEQ ID NO: |
|---|---|---|---|---|
| IGHD4-17 | 14 | CARHPKPPTVTSATT | 2 | 487 |
| | | CAKGENTVTTGQEYW | 2 | 488 |
| | | CAKGENTVTTGQEY | 2 | 489 |
| IGHD3-9 | 12 | CAREGRNYDSLTGDPWFDPW | 2 | 490 |
| IGHD2-2 | 12 | CASRYCTSDRCLGASGKPSFDTW | 2 | 491 |
| | | CARHSLAYCSTTSCAVFDYW | 2 | 492 |
| | | CARHGFEGREVVPPAMNEYYYYYMDVW | 2 | 493 |
| IGHD1-7 | 11 | CARGDCTTINCNTHSDYYGLDVW | 3 | 494 |
| | | CARTVGTGTTNGYLTS | 2 | 495 |
| | | CAREIVLLSTATLTPTTTVWTS | 2 | 496 |
| IGHD5-12 | 10 | CARQDSGYDYGYYHNGMDVW | 2 | 497 |
| IGHD4-23 | 9 | CARGAGYGGNSGVRTT | 6 | 498 |
| IGHD2-21 | 9 | | | |
| IGHD6-19 | 8 | CARDLGSGWFRFDP | 2 | 499 |
| | | CARDLGSGWFGSTP | 2 | 500 |
| IGHD2-8 | 7 | CAKSHHCTNGVCHPPRFGQRSTP | 2 | 501 |
| IGHD1-26 | 6 | | | |
| IGHD1-20 | 2 | | | |
| (unidentified) | 773 | CARGATVGVETGSTP | 32 | 502 |
| | | CARKGSRHGGSTP | 28 | 503 |
| | | CARQNGPSIGGGSTP | 23 | 504 |
| | | CARGATPGAETGSTP | 23 | 505 |
| | | CAKDTLGGMGGLTS | 13 | 506 |
| | | CARVRVLPEGVLISLRPLGSTTITWTS | 11 | 507 |
| | | CARGGPKKVVTAAHLSP | 11 | 508 |
| | | CSTLGLGPPGGQTT | 10 | 509 |
| | | CARDHYDTRGVRMLLIS | 10 | 510 |
| | | CATDRDSSWGTSLTT | 9 | 511 |
| | | CARMVRGGGRTSSGYYYYYMDVW | 9 | 512 |
| | | CARDGVWDLPTTLTT | 9 | 513 |
| | | CVRMGPPCQLAGRSSSLTS | 6 | 514 |
| | | CTMATVGHGLRRCFGKSTATLTS | 6 | 515 |
| | | CARRGGSTVTTGTSIS | 6 | 516 |
| | | CSTLGLGPPGGLTT | 5 | 517 |
| | | CMGPGETAI | 5 | 518 |
| | | CARVSMIRFRVWGLWTS | 5 | 519 |
| | | CARVQRGAVVIPTT | 5 | 520 |
| | | CARRRYNDLGAPNWVDPW | 5 | 521 |
| | | CARGEDCGGGRCNNLPTTVWTS | 5 | 522 |
| | | CAKRKLAPPRKFTTLTT | 5 | 523 |
| | | CATLEGGAPPDLRRAEAFLLIS | 4 | 524 |
| | | CARQDPYCSTSNCTMGGAMTLTT | 4 | 525 |
| | | CARGKDCGGGRCNNVPYYGMDVW | 4 | 526 |
| | | CAKDGHKLTGTTTRTS | 4 | 527 |
| | | CAILPETQWYPRLTT | 4 | 528 |
| | | CVRDLGAITPVFSTS | 3 | 529 |
| | | CVHRPRWLNVVPT | 3 | 530 |
| | | CVHRPRWLNVVPN | 3 | 531 |
| | | CARSFVVKVHAHCGAVLSST | 3 | 532 |
| | | CARRLNAVVVPAYVGWFDPW | 3 | 533 |
| | | CARLGKNHSQGVDYW | 3 | 534 |
| | | CARGPGGVWDRLSLTS | 3 | 535 |
| | | CARGKDCGGGRCNNVPTTGWTS | 3 | 536 |
| | | CARGFMVQASSVRLKRGQFLADSW | 3 | 537 |
| | | CARGDWGTVTLATT | 3 | 538 |
| | | CARDWEWQQRLNYFDP | 3 | 539 |
| | | CARDNQPWRDARNLGGAFDVW | 3 | 540 |
| | | CARDGLRPPPFMVTIQGGLTT | 3 | 541 |
| | | CARAVGGFNSGWPSIGVPARSTP | 3 | 542 |
| | | CARAVGGFNSGWPSIGVPARSTL | 3 | 543 |
| | | CAKVDETVVLPAALLTP | 3 | 544 |
| | | CAKSPKPWSQLVSTPIMPTPWTS | 3 | 545 |
| | | CVRRAAGGRSGLTT | 2 | 546 |

TABLE 2-3-continued

Comparison of D repertoire among classes,
vertical axis: frequency (%), horizontal axis: gene name

| gene name | num reads | CDR3 amino acids | num reads | SEQ ID NO: |
|---|---|---|---|---|
| | | CVRPPPTVPGTAGSTP | 2 | 547 |
| | | CVRESTFYYFGPW | 2 | 548 |
| | | CVRDDDYSRTWYMGQGASSDYGMDVW | 2 | 549 |
| | | CVKWVSGVLTSLTT | 2 | 550 |
| | | CVALFVPAGSTL | 2 | 551 |
| | | CTMATVGHGATTLFREVHRNTDFW | 2 | 552 |
| | | CSTLGLGPRGADYW | 2 | 553 |
| | | CSRTGGRLLIS | 2 | 554 |
| | | CSKVGRILKLIT | 2 | 555 |
| | | CKVAVEMVLMY | 2 | 556 |
| | | CGKFLGTTVASS | 2 | 557 |
| | | CATSGRSSAWYPDVFDIW | 2 | 558 |
| | | CATNYCRGISCYPAPLTT | 2 | 559 |
| | | CATLTGGAPPDLRRAEAFLLIS | 2 | 560 |
| | | CATEGTGAVTPFTT | 2 | 561 |
| | | CATAPGGTSYT | 2 | 562 |
| | | CASRPSWGSSFDFW | 2 | 563 |
| | | CASRPPGAAALTS | 2 | 564 |
| | | CASMIALHHTLTS | 2 | 565 |
| | | CARYSPVDPSTLDFW | 2 | 566 |
| | | CARVLDSSAHWYFDDW | 2 | 567 |
| | | CARRRYNDLGAPTGSTP | 2 | 568 |
| | | CARQNGPSIGGGSTL | 2 | 569 |
| | | CARQHSEWEILRLVFDHW | 2 | 570 |
| | | CARMVREEAERRPAHITTWTS | 2 | 571 |
| | | CARLPRMVRVTGSTP | 2 | 572 |
| | | CARIDYVSTWYYDQW | 2 | 573 |
| | | CARICAEREFLSLLTP | 2 | 574 |
| | | CARGPGWGMGSTKFDCW | 2 | 575 |
| | | CARGGKSATGNYHQFFDCW | 2 | 576 |
| | | CARGDCTTINCNTHSTTTVWTS | 2 | 577 |
| | | CARGATVGVETGSTL | 2 | 578 |
| | | CARGATLGVETGWTP | 2 | 579 |
| | | CAREYYGILYGYYFDYW | 2 | 580 |
| | | CARDWEWQQRLNYFDPW | 2 | 581 |
| | | CARDNQPWRDARNLGVHLMC | 2 | 582 |
| | | CARDHYYDERNQGPDW | 2 | 583 |
| | | CARDGGLAGTGTLEY | 2 | 584 |
| | | CARAGLVLGPYGMDIW | 2 | 585 |
| | | CARAGGHGTWTS | 2 | 586 |
| | | CAKVAETLVSTGFDSYYAYSMDVW | 2 | 587 |
| | | CAKTYDYGSRGFSILLIS | 2 | 588 |
| | | CAKSLRVGGDVFEIW | 2 | 589 |
| | | CAKSDYFDP | 2 | 590 |
| | | CAKGRGRLVTIATTLTT | 2 | 591 |
| | | CAKGAGRRAAGKFLTT | 2 | 592 |
| | | CAKAKRRSLGMQTLPTLRGRSDGFFDVW | 2 | 593 |
| | | CAKAHFPGDLPSFSSIS | 2 | 594 |
| | | CAKADCGTGCFIVDDW | 2 | 595 |
| | | CAHQQWRPGRRGFDYW | 2 | 596 |
| | | IgM | | |
| IGHD6-13 | 148 | CARTYSSWYRGPLSP | 24 | 597 |
| | | CTRQEESSAAGTGGTSSP | 16 | 598 |
| | | CARPIAAAGSRGFGTLTT | 15 | 599 |
| | | CAQRRPSSSTWYAPTLTT | 7 | 600 |
| | | CAQRRPNSSTWYAPTLTT | 4 | 601 |
| | | CARDLGGYSSSWSTNYYYYMDVW | 3 | 602 |
| | | CAKVNWGIAAAGSYAFDIW | 3 | 603 |
| | | CAHRVRGMTSSSWYYGTFDYW | 3 | 604 |
| | | CVRPGATAGTLLTV | 2 | 605 |
| | | CARTYSSWYRGGPLSP | 2 | 606 |
| | | CARPQRYSSSWYDDYYYGMDVW | 2 | 607 |
| | | CARPIAAAGSRGVRYFDYW | 2 | 608 |
| | | CARGVLAPLYSSTLKLRFSVWTS | 2 | 609 |
| | | CARGLVAAAGTRRGWFTP | 2 | 610 |
| | | CARGLVAAAGTRRGWFDPW | 2 | 611 |
| | | CARDSGQIVAAVTLDYW | 2 | 612 |
| | | CARAPSIPVAGIGYHFDHW | 2 | 613 |
| | | CAQRRPNSSWYRPLTLTT | 2 | 614 |
| | | CAKVNWGYSSCWFLRFLIS | 2 | 615 |
| | | CAKEGVPIAAPGLTT | 2 | 616 |
| | | CAHSRAAAGSLTT | 2 | 617 |

TABLE 2-3-continued

Comparison of D repertoire among classes,
vertical axis: frequency (%), horizontal axis: gene name

| gene name | num reads | CDR3 amino acids | num reads | SEQ ID NO: |
|---|---|---|---|---|
| | | CAHSRAAAGSFDYW | 2 | 618 |
| | | CAHRVRGNDKQQLVLWGPLTT | 2 | 619 |
| | | CAHRVRGMTSSSWYYGTLTT | 2 | 620 |
| IGHD2-15 | 123 | CARVEGGLTT | 15 | 621 |
| | | CAKGWTAARGALNTSST | 14 | 622 |
| | | CARFWSGVGLTT | 7 | 623 |
| | | CAREVYLYCNGGRCYWRGSSP | 5 | 624 |
| | | CARSEYCRGGNCYFNGYYFDSW | 3 | 625 |
| | | CARAPYCSGGSCYLFDYW | 3 | 626 |
| | | CARGFVVVVTATLGTTITPWTS | 2 | 627 |
| | | CARDLCGGSCSRTTGSTP | 2 | 628 |
| | | CARAGYCSGGSCYGWFDPW | 2 | 629 |
| | | CAKTKTGTTKINTTLTT | 2 | 630 |
| | | CAKNGILTGWVNGYTTLTT | 2 | 631 |
| | | CAKGQTTAILGSTDFNWFDPW | 2 | 632 |
| | | CAKFHLQPSLLMVRRSPTS | 2 | 633 |
| IGHD3-22 | 117 | CARDPRGAVGITTGPTH | 9 | 634 |
| | | CARGSPPGAVGFIGSTP | 8 | 635 |
| | | CAKDMGGITMIVVVMISLTT | 6 | 636 |
| | | CARARRGHGSTTTWTS | 5 | 637 |
| | | CARDPPRMLLIS | 4 | 638 |
| | | CARDLSYYDSSGYYAYW | 4 | 639 |
| | | CATYKYYDSSGFMTT | 3 | 640 |
| | | CATYKYYDSSGFHDYW | 3 | 641 |
| | | CARDLSYYDSSGYYAYV | 3 | 642 |
| | | CAHRPYYYDSSGYYYAFDYW | 3 | 643 |
| | | CLTMIVPT | 2 | 644 |
| | | CATVTGGSSGYYYHVYYFDYW | 2 | 645 |
| | | CARVRYSGGILGLPLTT | 2 | 646 |
| | | CARGRRGIVVVIPKEVRFDYW | 2 | 647 |
| | | CARGIWVSTGYYRYYFDNW | 2 | 648 |
| | | CAREGYDSGYYYEVEAFDIW | 2 | 649 |
| | | CARDAGPITTTVAGIIMRLLTF | 2 | 650 |
| | | CAHRRPITMIVVVITMPLTT | 2 | 651 |
| IGHD5-5 | 89 | CARGGGKDLLASYLTT | 19 | 652 |
| | | CTSRGYSYGAPRWD | 7 | 653 |
| | | CARRWGRGRDTAMNLTTTTVWTS | 7 | 654 |
| | | CSRGGPGTAMVST | 3 | 655 |
| | | CARRGGGGDTAMNLTTTTVWTS | 3 | 656 |
| | | CARHGDSFVQPRRTT | 3 | 657 |
| | | CAKHDGQSNTLTA | 3 | 658 |
| | | CATNTAMGFNEAVLIS | 2 | 659 |
| | | CARRGYSSMGIWDLST | 2 | 660 |
| | | CARRGGRGRDTAMNLTTTTVWTS | 2 | 661 |
| | | CARQGSRLFHYYYYYMDVW | 2 | 662 |
| | | CARHKPGYSYVFLTT | 2 | 663 |
| IGHD3-10 | 78 | CGREGAGSAPWTS | 5 | 664 |
| | | CARHRITMVRELSYTTTWTS | 5 | 665 |
| | | CARDSDQQHGVRGLTTTWTS | 5 | 666 |
| | | CATTPLMTLVRGLTTTWTS | 4 | 667 |
| | | CARHQVSMVRGVTRSTGSTP | 4 | 668 |
| | | CARDEWFGESEVTNLDAFDIW | 3 | 669 |
| | | CAHSEGRITMVRGVIGPFDYW | 3 | 670 |
| | | CARGQTYGSGPRGFDPW | 2 | 671 |
| | | CARGLYGSGSYYIKRRKTGSTP | 2 | 672 |
| | | CARAMVRGVLALTT | 2 | 673 |
| | | CAKVGVGSMTMDRGVMTT | 2 | 674 |
| IGHD3-3 | 77 | CARDPFGVVISTVWTS | 14 | 675 |
| | | CARDRGRVLRFCPQGVPSLTT | 8 | 676 |
| | | CASQTYYDFGVVIILLTTLTT | 5 | 677 |
| | | CASLDFGVVIILTS | 4 | 678 |
| | | CARHRSTTILEWFVNHETGSTP | 4 | 679 |
| | | CAQSHYDFGVVIILIPGSTP | 4 | 680 |
| | | CARGSPHYDFFGVVEIRTGSTP | 3 | 681 |
| | | CARDPLWSGYFYGMDVW | 3 | 682 |
| | | CARVGTYDFGVVMSNS | 2 | 683 |
| | | CARHRSITIFGVVRKSRNQFDPW | 2 | 684 |
| | | CARDRFSLNSAFGVVEGSYWFDPW | 2 | 685 |
| | | CAQSHYDFWSGYYSNTGFDPW | 2 | 686 |

TABLE 2-3-continued

Comparison of D repertoire among classes,
vertical axis: frequency (%), horizontal axis: gene name

| gene name | num reads | CDR3 amino acids | num reads | SEQ ID NO: |
|---|---|---|---|---|
| IGHD1-26 | 51 | CASVGGTRGPGDPGLGT | 12 | 687 |
| | | CAKGGFIVGATLTT | 4 | 688 |
| | | CAKEGGRIVGATMTT | 3 | 689 |
| | | CARVRYSGRYSRSTVDYW | 2 | 690 |
| | | CARLKCGLTTCLHKTLIS | 2 | 691 |
| | | CARDSVGATTTDYW | 2 | 692 |
| IGHD6-19 | 50 | CAHPGSGWPLTTLTT | 6 | 693 |
| | | CARGCSVAGTGSSTP | 4 | 694 |
| | | CARARITVAAPYDYW | 4 | 695 |
| | | CARLISSGWYLTT | 3 | 696 |
| | | CARTSLEQQLVFMTENSSGWSFDYW | 2 | 697 |
| | | CARGGIAVAGTRIKTTT | 2 | 698 |
| | | CARDQQWLPDYV | 2 | 699 |
| | | CARARITVAAPYDY | 2 | 700 |
| | | CARARITVAAPMTT | 2 | 701 |
| | | CAKGVGSGWYDFFDYW | 2 | 702 |
| | | CAKGPREQWLAPYWYFDLW | 2 | 703 |
| IGHD3-9 | 39 | CARGGSLVLDVLTT | 17 | 704 |
| | | CARGGSLMLDVLTT | 10 | 705 |
| | | CASGPYFDWLLTYMDVW | 2 | 706 |
| | | CARGPLYDILTGPTPTTTTTWTS | 2 | 707 |
| | | CARGGSIVLDVLTT | 2 | 708 |
| IGHD2-8 | 30 | CAKWGGNSSWKS | 7 | 709 |
| | | CARRSWCTNGVCYYISVALVTGSTP | 6 | 710 |
| | | CARGSRYCTNGVCYFWFDPW | 3 | 711 |
| | | CARDVLGYCTATACWRGGPNHYYYGMDVW | 3 | 712 |
| IGHD5-24 | 28 | CARGIEMATILLTT | 16 | 713 |
| | | CARGSRWLQFFDYW | 3 | 714 |
| | | CAKGGERWLQSGATTLTT | 2 | 715 |
| IGHD6-6 | 22 | CTRGLVIEDIAARPGGA | 2 | 716 |
| | | CASDRGVQLVQDYYFGMDVW | 2 | 717 |
| IGHD5-12 | 21 | CARNARGGVATIFRGSTP | 8 | 718 |
| | | CARIQVATIDPKPKRLPSVWTS | 2 | 719 |
| IGHD4-17 | 19 | CARDWNGDYDYYYYGMDVW | 6 | 720 |
| | | CARDWNGDYTTTTTVWTS | 2 | 721 |
| IGHD2-2 | 16 | CARDRSSTSCCHFDYL | 2 | 722 |
| IGHD2-21 | 13 | CARGPAYCGSDCYSYFQHW | 2 | 723 |
| IGHD4-23 | 9 | CARGGDYGGTPLTT | 6 | 724 |
| IGHD1-7 | 6 | CARDGPPRITGTTEVTT | 3 | 725 |
| IGHD1-1 | 6 | CARRVGASGTSIS | 4 | 726 |
| IGHD3-16 | 4 | CARAHYDYVWGDYRSPPTT | 2 | 727 |
| IGHD1-20 | 4 | | | |
| IGHD4-4 | 3 | CARPVTTGTHRGYFDLW | 2 | 728 |
| (unidentified) | 834 | CASVGGTRVPGDPGLGT | 35 | 729 |
| | | CAHLTITFGEFSERMLSTS | 29 | 730 |
| | | CARLGYYDRRTT | 27 | 731 |
| | | CAGEVVIWNSMTT | 18 | 732 |
| | | CARGARGDNSTMT | 15 | 733 |
| | | CARGGSRWPRTTLTT | 13 | 734 |
| | | CARMGGPPTGTSIS | 12 | 735 |
| | | CVRGGLYTIPT | 11 | 736 |
| | | CARGGCGNYCPTTTSWTS | 11 | 737 |
| | | CARRDSSRGTTLTT | 10 | 738 |
| | | CARTTGTTTTTWTS | 8 | 739 |
| | | CARLSRYSNSPPSLTT | 8 | 740 |
| | | CARHLGVRGPWALFIS | 7 | 741 |
| | | CARDPPRMLLIS | 7 | 742 |

TABLE 2-3-continued

Comparison of D repertoire among classes,
vertical axis: frequency (%), horizontal axis: gene name

| gene name | num reads | CDR3 amino acids | num reads | SEQ ID NO: |
|---|---|---|---|---|
| | | CAKGDIVTT | 7 | 743 |
| | | CARGGGVSSRRITSTP | 6 | 744 |
| | | CAREGVRSLTT | 6 | 745 |
| | | CAKDKTYDTHGYSPF | 6 | 746 |
| | | CASLLLPTVTGGVLLIS | 5 | 747 |
| | | CARDYGATGSLDC | 5 | 748 |
| | | CARDFGSGGVLITWPS | 5 | 749 |
| | | CARYPGIEVTGTGALTT | 4 | 750 |
| | | CARRGDVGNYCPTTTSWTS | 4 | 751 |
| | | CARLPGITTTTTWTS | 4 | 752 |
| | | CARHVKPVDGNAYYEDSV | 4 | 753 |
| | | CARGTRGISEPTKFDYW | 4 | 754 |
| | | CARGGPERQLDDS | 4 | 755 |
| | | CAHRRPDSSTWYAPTLTT | 4 | 756 |
| | | CVSRRQTTPTSTVGPS | 3 | 757 |
| | | CVRKEVMYFDP | 3 | 758 |
| | | CGDTLGETMPVTA | 3 | 759 |
| | | CATRRGQFWTT | 3 | 760 |
| | | CARVVGGGVTTTTTVWTS | 3 | 761 |
| | | CARVLLSGSTWYAEYFQSW | 3 | 762 |
| | | CARTLSATGDNWFGPW | 3 | 763 |
| | | CARTGARGDNSTMTS | 3 | 764 |
| | | CARQTPGTLQTTTTTTVWTS | 3 | 765 |
| | | CARPRYDYGLLLIS | 3 | 766 |
| | | CARLTRRTTVVPRTSTT | 3 | 767 |
| | | CARHVKPVDGNAYYEDSW | 3 | 768 |
| | | CARHRGVRGPWALFIS | 3 | 769 |
| | | CARGSPPGAVGFIGSTP | 3 | 770 |
| | | CARGLSSSRSLSSTP | 3 | 771 |
| | | CARGGATPGG | 3 | 772 |
| | | CAREVPTGPRTSTTVWTS | 3 | 773 |
| | | CARDPRADYLAFDIW | 3 | 774 |
| | | CANGDTARPTGTLAT | 3 | 775 |
| | | CAKAPSDTIIVHGPQHLTT | 3 | 776 |
| | | CAARGRTTLTT | 3 | 777 |
| | | CVRGSGRTGEAT | 2 | 778 |
| | | CVREARTPATTYGWYYYDYW | 2 | 779 |
| | | CVRDNSWSSRDAERYYYNMDVW | 2 | 780 |
| | | CVRDLAWRTQQLLSENWFDPW | 2 | 781 |
| | | CVRDLAWRTQQLLSEIGSTV | 2 | 782 |
| | | CVRDLAWRTEQLLSENWFDPW | 2 | 783 |
| | | CVRDLAWRTEELLSENWFDTW | 2 | 784 |
| | | CVRDLAWRTEELLSENWFDPW | 2 | 785 |
| | | CVRDLAWRTEELLSEIGSTL | 2 | 786 |
| | | CVHRPRWLNIVANV | 2 | 787 |
| | | CTWWQQLGEFLTS | 2 | 788 |
| | | CTSLTSMVNFMLLMS | 2 | 789 |
| | | CTRQEESSAAGTGGTSSP | 2 | 790 |
| | | CTRDGVRGDLNPTLNV | 2 | 791 |
| | | CMRHQHQRPRTT | 2 | 792 |
| | | CITDCTGGSCDFAGPGEYW | 2 | 793 |
| | | CATYYYKLVVIDTLTT | 2 | 794 |
| | | CATGAATVLLTT | 2 | 795 |
| | | CASRPGHHSGPLTT | 2 | 796 |
| | | CASRPGHHSGPFDYW | 2 | 797 |
| | | CASPVGGGET | 2 | 798 |
| | | CARWPPIQGELLIS | 2 | 799 |
| | | CARVRSGLLPTTTTTWTS | 2 | 800 |
| | | CARVQLIGDSGYRPWTT | 2 | 801 |
| | | CARVLRGPTTLTT | 2 | 802 |
| | | CARQWGIRGVALTT | 2 | 803 |
| | | CARPRYDLRFCLLIS | 2 | 804 |
| | | CARNTEATTT | 2 | 805 |
| | | CARMPGKEIAMADLATLTT | 2 | 806 |
| | | CARLTRRTTVGTPDIDYV | 2 | 807 |
| | | CARHVKPVDGNAYYEDS | 2 | 808 |
| | | CARHLVW | 2 | 809 |
| | | CARHDPVPQFKHGWTS | 2 | 810 |
| | | CARGGPGRQLTMT | 2 | 811 |
| | | CARGGGKDLLASYLTT | 2 | 812 |
| | | CARGARSGSSMTA | 2 | 813 |
| | | CARDYGATGSLDCW | 2 | 814 |
| | | CARDVIGAASYVAFDIW | 2 | 815 |
| | | CARDEWFGSPKSRTLMLLIS | 2 | 816 |

TABLE 2-3-continued

Comparison of D repertoire among classes,
vertical axis: frequency (%), horizontal axis: gene name

| gene name | num reads | CDR3 amino acids | num reads | SEQ ID NO: |
|---|---|---|---|---|
| | | CARAQNWDLLTGTSIS | 2 | 817 |
| | | CARAPSIPVAVSATTLTT | 2 | 818 |
| | | CAKHDGQSNTPDCW | 2 | 819 |
| | | CAKGWTAARGALNTSST | 2 | 820 |
| | | CAKGPPVVTTLDTSST | 2 | 821 |
| | | CAKDRGGS | 2 | 822 |

TABLE 2-4

Comparison of D repertoires among classes,
vertical axis: frequency (%), horizontal axis: gene name

| gene name | num reads | CDR3 amino acids | num reads | SEQ ID NO: |
|---|---|---|---|---|
| IGHA1 | | | | |
| IGHD3-22 | 35 | CARRPIPPLTMRVVIPLTS | 5 | 823 |
| | | CARDPPMPMIVVQTLTT | 2 | 824 |
| | | CARDPPMPMILVQTLTT | 2 | 825 |
| | | CAKILITMILVVSLMLLIS | 2 | 826 |
| IGHD6-13 | 27 | CGRSRHSSSWQILTP | 11 | 827 |
| | | CANGGLAAAGDHLTT | 5 | 828 |
| | | CARAPSIPVAGIGYHFDHW | 3 | 829 |
| | | CARAPSIPVAGIATTLTT | 2 | 830 |
| IGHD3-10 | 26 | CAREIRGTTMVRELTTSTATWTP | 6 | 831 |
| | | CVRTYYFGLGDIITEITSTVWTS | 3 | 832 |
| | | CARRTYYYGSTNLTT | 2 | 833 |
| | | CARMVTDYYGSGNRGWFDPW | 2 | 834 |
| | | CARDYYGSGVMTL | 2 | 835 |
| IGHD5-5 | 19 | CMGPGDTAI | 7 | 836 |
| | | CARRPREMESAMVLSLTT | 2 | 837 |
| IGHD3-9 | 19 | CAHSAPYYDILSRNRARSWKDFDNW | 3 | 838 |
| | | CAHSAPIMIFCLVTAHEVGRILTT | 3 | 839 |
| | | CATVALLRYFDWSSTR | 2 | 840 |
| IGHD3-3 | 17 | CTRRGGVVIICLTT | 2 | 841 |
| | | CIHTGNDFWTGTNYGLTS | 2 | 842 |
| | | CAKDRFSGRGRFEFMEWLTPLTT | 2 | 843 |
| | | CAKDRFSEGKVQFMEWLTPLTT | 2 | 844 |
| IGHD6-19 | 14 | CARGRRSLPAIVYSSGPDRPNWFDPW | 6 | 845 |
| | | CTSAAVASSSGWPLRGVWTS | 3 | 846 |
| IGHD2-2 | 14 | CARAPLCSSASCHLQLDYW | 5 | 847 |
| IGHD1-26 | 13 | CARDDSASYSRGTT | 3 | 848 |
| IGHD2-21 | 12 | CARSHIVVVTAIPLEMLLIS | 2 | 849 |
| IGHD4-23 | 11 | CARGAGYGGNSGVRTT | 9 | 850 |
| IGHD2-15 | 11 | CAKDLAPLKSCSRGGCYPYYYGLDIW | 3 | 851 |
| IGHD4-17 | 9 | CARTLYGDFVDF | 2 | 852 |
| IGHD6-6 | 5 | | | |
| IGHD5-12 | 4 | CARHVNGYDYLFPFTSW | 3 | 853 |
| IGHD3-16 | 4 | CAKGVLSSGGVIATLPGSTP | 3 | 854 |
| IGHD1-1 | 3 | CARGGSQLERRRRPLVTT | 3 | 855 |
| IGHD5-24 | 2 | | | |
| IGHD2-8 | 2 | | | |

TABLE 2-4-continued

Comparison of D repertoires among classes,
vertical axis: frequency (%), horizontal axis: gene name

| gene name | num reads | CDR3 amino acids | num reads | SEQ ID NO: |
|---|---|---|---|---|
| (unidentified) | 531 | CARETVGGTLTT | 19 | 856 |
| | | CARISSGHDPPIITGWTS | 13 | 857 |
| | | CARSPIWFGSHRFTTTWRS | 9 | 858 |
| | | CARDPLETGATSLII | 9 | 859 |
| | | CAKLGNRPGFTEWDHWFGPW | 9 | 860 |
| | | CVRDPHETGATTLIT | 6 | 861 |
| | | CARIRKEVGAPPITWTS | 6 | 862 |
| | | CARGSWSGAAFYSLTT | 6 | 863 |
| | | CARDPNKFRTNHLSTT | 6 | 864 |
| | | CATVPELTDISLPRLMALIS | 5 | 865 |
| | | CARVWGKHTLTT | 5 | 866 |
| | | CARDPNKFRPNHLSTT | 5 | 867 |
| | | CARAGRELLRALMTT | 5 | 868 |
| | | CARAGAELLRALMTT | 5 | 869 |
| | | CARAEDYYDTEGYFYLTP | 5 | 870 |
| | | CAHRTNYSTNRYGAFTTLTS | 5 | 871 |
| | | CVRDPQETGATTLIT | 4 | 872 |
| | | CATQCLGGAGLTTTTAPWTS | 4 | 873 |
| | | CARRTYYSGSTNLTT | 4 | 874 |
| | | CARRTTRETGSSIS | 4 | 875 |
| | | CVRQYGLGSGSLTP | 3 | 876 |
| | | CVKIRNLIGFTGSTP | 3 | 877 |
| | | CTRDGVRGDLNPTLNV | 3 | 878 |
| | | CDKAKVTADLRT | 3 | 879 |
| | | CATVPELPDISLPRLMALIS | 3 | 880 |
| | | CATVFGRRYRLLTT | 3 | 881 |
| | | CARYRAAYPRRAWTS | 3 | 882 |
| | | CARTIGFEIAMTGGLGALTP | 3 | 883 |
| | | CARRDPPVRASLSTTLTS | 3 | 884 |
| | | CARFQRYCRGGSCSATLDAFDKW | 3 | 885 |
| | | CARDLGERRDGEPTNWFDAW | 3 | 886 |
| | | CARDLAVWATLTT | 3 | 887 |
| | | CAKDVEPTVTLYNHFDP | 3 | 888 |
| | | CAKDFNWEGIT | 3 | 889 |
| | | CAHRTNYSTNRYGGLYYFDFW | 3 | 890 |
| | | CVRGVGTILWLTI | 2 | 891 |
| | | CVRDAGPGGSLTS | 2 | 892 |
| | | CTTGFSGSTACHWDHTACHWDDAFAMW | 2 | 893 |
| | | CTHAVESLLGTTSTS | 2 | 894 |
| | | CIHTGNDFGPGPTMVWTS | 2 | 895 |
| | | CGVGRGDNDVDFKFKW | 2 | 896 |
| | | CATRESPLTT | 2 | 897 |
| | | CATAGIELWRAGSTP | 2 | 898 |
| | | CARYRIAMATSPYFDVW | 2 | 899 |
| | | CARTNFGSGGYILGDTTMVWTS | 2 | 900 |
| | | CARSAGYLHRRTS | 2 | 901 |
| | | CARRTYYSGSTNFDYW | 2 | 902 |
| | | CARRDLPFGASLSTTLTS | 2 | 903 |
| | | CARPGFSYGPRLTP | 2 | 904 |
| | | CARKKIPTAGYSSLTT | 2 | 905 |
| | | CARGSWMGRPFISLTT | 2 | 906 |
| | | CARGLRWADN | 2 | 907 |
| | | CARGGTSGLILDTTSTPWTS | 2 | 908 |
| | | CAREMHIDSLTVGRAFDIW | 2 | 909 |
| | | CARDVPDIYSSGATDC | 2 | 910 |
| | | CARDPSYLPTPALKT | 2 | 911 |
| | | CARDPNKFRPNHFVDYW | 2 | 912 |
| | | CARDLGTTNYWLDTW | 2 | 913 |
| | | CAKQRASGNSLTI | 2 | 914 |
| | | CAKEPKIVGRRRTTLIT | 2 | 915 |
| | | CAKDLGVCSEGAASSLVLIS | 2 | 916 |
| | | CAHSAPYYDICLVTAHEVGRILTT | 2 | 917 |
| | | CAGLIGRFIPLTT | 2 | 918 |
| IGHA2 | | | | |
| IGHD2-21 | 62 | CAKDMCGLWASCGGDCYSRRTTSLTT | 41 | 919 |
| | | CAKDMCGLWASCGGDCYSRRTASLTT | 5 | 920 |
| | | CARGPNMAFVVVTAILMLLIS | 4 | 921 |
| | | CARAPDCGGSTCYSHPYYGMDVW | 4 | 922 |
| | | CARDPRIVVVAPATHTPTTVWTS | 2 | 923 |

TABLE 2-4-continued

Comparison of D repertoires among classes,
vertical axis: frequency (%), horizontal axis: gene name

| gene name | num reads | CDR3 amino acids | num reads | SEQ ID NO: |
|---|---|---|---|---|
| IGHD3-3 | 20 | CIYDFWSGGPHPTLTT | 11 | 924 |
| | | CARIVNTEGFWSGFLTP | 4 | 925 |
| | | CARIVNTEGFGVVFLTP | 2 | 926 |
| IGHD2-15 | 18 | CARAPDCGGGTCYSHPTTVWTS | 5 | 927 |
| | | CARARIVVVPATLTPTTVWTS | 2 | 928 |
| | | CARAPDCGGGTCYSHPYYGMDVW | 3 | 929 |
| IGHD6-13 | 14 | CALCPTPIAAAGSVTT | 5 | 930 |
| | | CALCPNPYSSGWFCNYW | 3 | 931 |
| IGHD1-26 | 9 | CARGPATAILGATPSLTP | 3 | 932 |
| | | CVRHDYSDNDLSTNWFGP | 2 | 933 |
| IGHD3-10 | 7 | CATYYYGSGSAGHNFDYW | 2 | 934 |
| | | CARGPGLSVMIRGVITTPNHILIT | 2 | 935 |
| IGHD2-8 | 6 | CANVGGADRNYCINGVRHNPNYLTT | 5 | 936 |
| IGHD3-16 | 5 | CARGFGARGVILT | 2 | 937 |
| IGHD5-12 | 1 | CVLSRGLVATRTLDYW | 1 | 938 |
| IGHD4-17 | 1 | CARTLYGDFVDSL | 2 | 939 |
| IGHD3-22 | 1 | CARDKQESSGSPRNYYFDYW | 1 | 940 |
| (unidentified) | 131 | CAKGHQVRLRGRTGTSIS | 11 | 941 |
| | | CAGAPDCGVGAAPLTSTTVCTS | 8 | 942 |
| | | CAGIGGATSTTTTTWTS | 6 | 943 |
| | | CARRAAPHDYGHVLIF | 5 | 944 |
| | | CVRHDGSFTKTGSTP | 4 | 945 |
| | | CVKIGAAH | 4 | 946 |
| | | CARLRCSNDNCAGHLYYYFSGLDIW | 4 | 947 |
| | | CARASLPRGLLIS | 4 | 948 |
| | | CTKGGGRKTAGKFLTP | 3 | 949 |
| | | CARTARTGDL | 3 | 950 |
| | | CARIGHEFYSLTYSVNDVFDLW | 3 | 951 |
| | | CAKGRRAAGKFLTT | 3 | 952 |
| | | CAKGAGRRAAGKFLTT | 3 | 953 |
| | | CVRFIGAYSNNWYPGYFDYW | 2 | 954 |
| | | CASQSQNYYYYMDVW | 2 | 955 |
| | | CASKKEILWAGPNLTT | 2 | 956 |
| | | CARVRCGLVASEGVLIS | 2 | 957 |
| | | CARRAAPMTTGMFLIF | 2 | 958 |
| | | CARLRGGFPPVVKRVEVFLLTS | 2 | 959 |
| | | CARGRFARGGDDSLIS | 2 | 960 |
| | | CAKAPGDLCRSTP | 2 | 961 |
| | | CAGIRGSNIYYHYYYMDVW | 2 | 962 |
| | | CADLPGIIGGEIT | 2 | 963 |
| IGHG1 | | | | |
| IGHD3-22 | 52 | CAKITSMIVVLIPTMMLLMS | 20 | 964 |
| | | CARGSRARFSSDTSGYQYFDYW | 4 | 965 |
| | | CARGVYLYYDSHAYSVLTT | 3 | 966 |
| | | CARVNYYDSVVLTT | 2 | 967 |
| | | CARVNYYDSSRIDYW | 2 | 968 |
| | | CARLPPFNNDDSSSYALYLTT | 2 | 969 |
| | | CARHSNYYYDTSGYRVLDAFDIW | 2 | 970 |
| | | CARGGMDSYGYFYVGHYDYW | 2 | 971 |
| | | CAKITSMIVVLTPTMMLLMS | 2 | 972 |
| IGHD3-10 | 35 | CARLPRMVRGNWFHP | 8 | 973 |
| | | CARGAWAVRGVISWAGSTP | 6 | 974 |
| | | CAGSGSGSLLTTVWTP | 4 | 975 |
| | | CVSITNSLLWFGELLIFDCW | 2 | 976 |
| IGHD6-13 | 31 | CTRQEESSAAGTGGTSSP | 7 | 977 |
| | | CALCPTPIAAAGSVTT | 7 | 978 |
| | | CATSEGDPVAAAGTKSWFDSW | 3 | 979 |
| | | CARLALLYGSSRYGATLTT | 2 | 980 |
| | | CARGPSSTWYSFDYW | 2 | 981 |

TABLE 2-4-continued

Comparison of D repertoires among classes,
vertical axis: frequency (%), horizontal axis: gene name

| gene name | num reads | CDR3 amino acids | num reads | SEQ ID NO: |
|---|---|---|---|---|
| IGHD3-3 | 20 | CAHSVGFILDFWSGYQNNWFDPW | 4 | 982 |
| | | CAMGPTIFGVVFLGSLTS | 2 | 983 |
| | | CAHSVGFILDFWSGYQNNWFDPG | 2 | 984 |
| | | CAHSVGFILDFGVVIRTTGSTP | 2 | 985 |
| IGHD3-16 | 19 | CVRQSPLDDVWGVFAPVGSTP | 11 | 986 |
| | | CVRQSPLDDVWGVFAPVGSTL | 2 | 987 |
| IGHD5-5 | 18 | CARGVDTTMVRSTTLTT | 7 | 988 |
| | | CARQDPYCSTSNCTMGGAMTLTT | 5 | 989 |
| IGHD5-24 | 14 | CARTDGIRDGYNLHRVLTT | 2 | 990 |
| | | CARTDAIRDGYNLHRVFDYW | 2 | 991 |
| IGHD3-9 | 11 | CAREGRNYDSLTGDPWFDPW | 2 | 992 |
| IGHD1-7 | 11 | CARGDCTTINCNTHSDYYGLDVW | 3 | 993 |
| | | CARTVGTGTTNGYLTS | 2 | 994 |
| | | CAREIVLLSTATLTPTTTVWTS | 2 | 995 |
| IGHD4-17 | 10 | CARHPKPPTVTSATT | 2 | 996 |
| IGHD5-12 | 9 | CARQDSGYDYGYYHNGMDVW | 2 | 997 |
| IGHD2-2 | 9 | CARHSLAYCSTTSCAVFDYW | 2 | 998 |
| | | CARHGFEGREVVPPAMNEYYYYYMDVW | 2 | 999 |
| IGHD2-15 | 9 | CALTGLNGRSCYSELLIS | 2 | 1000 |
| IGHD4-23 | 7 | CARGAGYGGNSGVRTT | 6 | 1001 |
| IGHD1-26 | 5 | | | |
| IGHD2-21 | 4 | | | |
| IGHD2-8 | 3 | | | |
| (unidentified) | 444 | CARGATVGVETGSTP | 32 | 1002 |
| | | CARKGSRHGGSTP | 28 | 1003 |
| | | CARQNGPSIGGGSTP | 23 | 1004 |
| | | CARGATPGAETGSTP | 23 | 1005 |
| | | CAKDTLGGMGGLTS | 13 | 1006 |
| | | CARVRVLPEGVLISLRPLGSTTITWTS | 11 | 1007 |
| | | CATDRDSSWGTSLTT | 9 | 1008 |
| | | CARRGGSTVTTGTSIS | 6 | 1009 |
| | | CARQDPYCSTSNCTMGGAMTLTT | 4 | 1010 |
| | | CAILPETQWYPRLTT | 4 | 1011 |
| | | CVHRPRWLNVVPT | 3 | 1012 |
| | | CVHRPRWLNVVPN | 3 | 1013 |
| | | CARLGKNHSQGVDYW | 3 | 1014 |
| | | CARGFMVQASSVRLKRGQFLADSW | 3 | 1015 |
| | | CARGDWGTVTLATT | 3 | 1016 |
| | | CARDNQPWRDARNLGGAFDVW | 3 | 1017 |
| | | CARDGLRPPPFMVTIQRGGLTT | 3 | 1018 |
| | | CARAVGGFNSGWPSIGVPARSTP | 3 | 1019 |
| | | CARAVGGFNSGWPSIGVPARSTL | 3 | 1020 |
| | | CAKSPKPWSQLVSTPIMPTPWTS | 2 | 1021 |
| | | CVRESTFYYFGPW | 2 | 1022 |
| | | CVRDDDYSRTWYGQGASSDYGMDVW | 2 | 1023 |
| | | CVKWVSGVLTSLTT | 2 | 1024 |
| | | CATSGRSSAWYPDVFDIW | 2 | 1025 |
| | | CATNYCRGISCYPAPLTT | 2 | 1026 |
| | | CASMIALHHTLTS | 2 | 1027 |
| | | CARYSPVDPSTLDFW | 2 | 1028 |
| | | CARVLDSSAHWYFDDW | 2 | 1029 |
| | | CARQNGPSIGGGSTL | 2 | 1030 |
| | | CARQHSEWEILRLVEDHW | 2 | 1031 |
| | | CARLPRMRVRTGSTP | 2 | 1032 |
| | | CARIDYVSTWYYDQW | 2 | 1033 |
| | | CARICAEREFLSLLTP | 2 | 1034 |
| | | CARGDCTTINCNTHSTTTVWTS | 2 | 1035 |
| | | CARGATVGVETGSTL | 2 | 1036 |
| | | CARGATLGVETGWTP | 2 | 1037 |
| | | CAREYYGILYGYYFDYW | 2 | 1038 |

TABLE 2-4-continued

Comparison of D repertoires among classes,
vertical axis: frequency (%), horizontal axis: gene name

| gene name | num reads | CDR3 amino acids | num reads | SEQ ID NO: |
|---|---|---|---|---|
| | | CARDNQPWRDARNLGVHLMC | 2 | 1039 |
| | | CARDGGLAGTGTLEY | 2 | 1040 |
| | | CARAGLVLGPYGMDIW | 2 | 1041 |
| | | CAKVAETLVSTGFDSYYAYSMDVW | 2 | 1042 |
| | | CAKTYDYGSRGFSILLIS | 2 | 1043 |
| | | CAKGAGRRAAGKFLTT | 2 | 1044 |
| | | CAKAKRRSLGMQTLPTLRGRSDGFDVW | 2 | 1045 |
| | | CAKADCGTGCFIVDDW | 2 | 1046 |
| IGHG2 | | | | |
| IGHD3-10 | 24 | CARGRYAGGVIITALTP | 13 | 1047 |
| | | CSREVGRDYYGSGVIEITWTS | 4 | 1048 |
| | | CSREVGRDYYGSGSYRNYMDVW | 3 | 1049 |
| IGHD2-15 | 22 | CAKKEFILVVVITMMSLLMS | 6 | 1050 |
| | | CAKDMTAKACSDYW | 3 | 1051 |
| | | CARVMGCRGGRCDFRAFDIW | 2 | 1052 |
| | | CARRFCSGGICYFLTT | 2 | 1053 |
| | | CAKEGVYFSGGNHYDVAFNVW | 2 | 1054 |
| IGHD6-25 | 21 | CARVKGGIAGMAWTS | 19 | 1055 |
| IGHD6-19 | 8 | CARDLGSGWFRFDP | 2 | 1056 |
| | | CARDLGSGWFGSTP | 2 | 1057 |
| IGHD3-3 | 8 | CARPSRCCYSGGGRLTL | 4 | 1058 |
| | | CARPSRCCYVRGGRLTL | 2 | 1059 |
| IGHD5-24 | 7 | CARGKRDAYNYYSHLDSW | 2 | 1060 |
| | | CARGKEMPTITTLILTP | 2 | 1061 |
| IGHD4-17 | 4 | CAKGENTVTTGQEYW | 2 | 1062 |
| | | CAKGENTVTTGQEY | 2 | 1063 |
| IGHD3-22 | 4 | CARDPDF | 2 | 1064 |
| IGHD2-8 | 4 | CAKSHHCTNGVCHPPRFGQRSTP | 2 | 1065 |
| IGHD6-13 | 3 | | | |
| IGHD5-5 | 3 | | | |
| IGHD2-21 | 3 | | | |
| IGHD2-2 | 3 | CASRYCTSDRCLGASGKPSFDTW | 2 | 1066 |
| IGHD4-23 | 2 | | | |
| IGHD1-20 | 2 | | | |
| (unidentified) | 317 | CARGGPKKVVTAAHLSP | 11 | 1067 |
| | | CSTLGLGPPGGQTT | 10 | 1068 |
| | | CARDHYDTRGVRMLLIS | 10 | 1069 |
| | | CARMVRGGGRTSSGYYYYYMDVW | 9 | 1070 |
| | | CARDGVWDLPTTLTT | 9 | 1071 |
| | | CTMATVGHGLRRCFGKSTATLTS | 6 | 1072 |
| | | CVRMGPPCQLAGRSSSLTS | 5 | 1073 |
| | | CSTLGLGPPGGLTT | 5 | 1074 |
| | | CMGPGETAI | 5 | 1075 |
| | | CARVSMIRFRVWGLWTS | 5 | 1076 |
| | | CARVQRGAVVIPTT | 5 | 1077 |
| | | CARRRYNDLGAPNWVDPW | 5 | 1078 |
| | | CARGEDCGGGRCNNLPTTVWTS | 5 | 1079 |
| | | CAKRKLAPPRKFTTLTT | 5 | 1080 |
| | | CATLEGGAPPDLRRAEAFLLIS | 4 | 1081 |
| | | CARGKDCGGGRCNNVPYYGMDVW | 4 | 1082 |
| | | CAKDGHKLTGTTTRTS | 4 | 1083 |
| | | CVRDLGAITPVFSTS | 3 | 1084 |
| | | CARSFVVKVHAHCGAVLSST | 3 | 1085 |
| | | CARRLNVAVVVPAYVGWFDPW | 3 | 1086 |
| | | CARGKDCGGGRCNNVPTTGWTS | 3 | 1087 |
| | | CARDWEWQQRLNYFDP | 3 | 1088 |
| | | CVRRAAGGRSGLTT | 2 | 1089 |

TABLE 2-4-continued

Comparison of D repertoires among classes,
vertical axis: frequency (%), horizontal axis: gene name

| gene name | num reads | CDR3 amino acids | num reads | SEQ ID NO: |
|---|---|---|---|---|
| | | CVRPPPTVPGTAGSTP | 2 | 1090 |
| | | CVALFVPAGSTL | 2 | 1091 |
| | | CTMATVGHGATTLFREVHRNTDFW | 2 | 1092 |
| | | CSTLGLGPRGADYW | 2 | 1093 |
| | | CSRTGGRLLIS | 2 | 1094 |
| | | CSKVGRILKLIT | 2 | 1095 |
| | | CKVAVEMVLMY | 2 | 1096 |
| | | CGKFLGTTVASS | 2 | 1097 |
| | | CATLTGGAPPDLRRAEAFLLIS | 2 | 1098 |
| | | CATEGTGAVTPFTT | 2 | 1099 |
| | | CATAPGGTSYT | 2 | 1100 |
| | | CASRPSWGSSFDFW | 2 | 1101 |
| | | CASRPPGAAALTS | 2 | 1102 |
| | | CARRRYNDLGAPTGSTP | 2 | 1103 |
| | | CARMVREEAERRPAIIITTWTS | 2 | 1104 |
| | | CARGPGWGMGSTKFDCW | 2 | 1105 |
| | | CARGPGGVWDRLSLTS | 2 | 1106 |
| | | CARGGKSATGANYHQFFDCW | 2 | 1107 |
| | | CARDWEWQQRLNYFDPW | 2 | 1108 |
| | | CARDHYYDERNQGPDW | 2 | 1109 |
| | | CARAGGHGTWTS | 2 | 1110 |
| | | CAKSLRVGGDVFEIW | 2 | 1111 |
| | | CAKSDYFDP | 2 | 1112 |
| | | CAKGRGRLVTIATTLTT | 2 | 1113 |
| | | CAKAHFPGDLPSFSSIS | 2 | 1114 |
| | | CAHQQWRPGRRGFDYW | 2 | 1115 |

The above results show that the analysis technique of the present invention can calculate and materialize quick analysis in several minutes.

Analytical Test Example 2

Comparison of BCR Repertoire Among Specimens

Figure 36A:
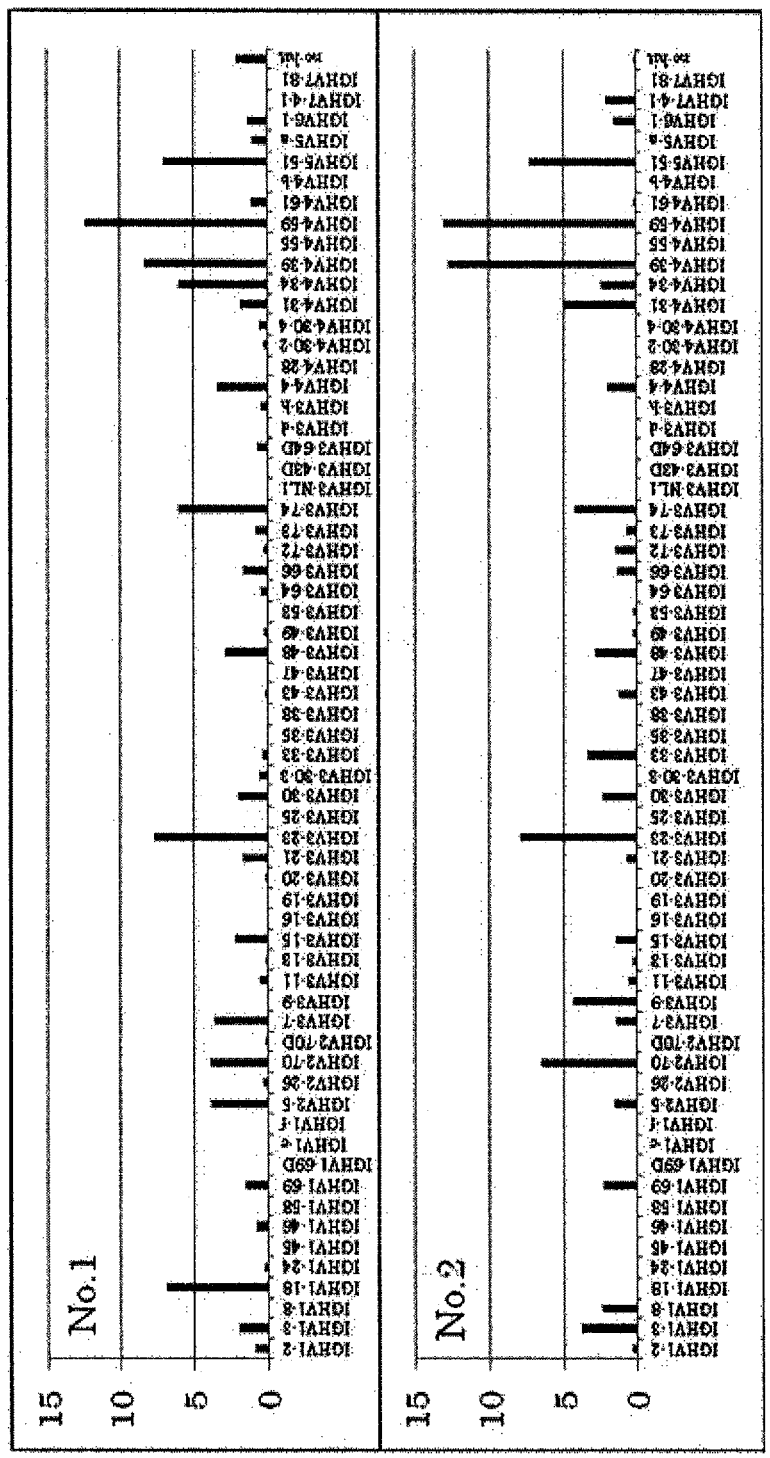
FIG. 36 (A and B) are diagrams showing a comparison of IgM V repertoires among specimens. The vertical axis indicates the frequency (%) and the horizontal axis indicates the gene names. No-hit indicates a frequency of genes that do not fall under any gene.
Figure 36B:
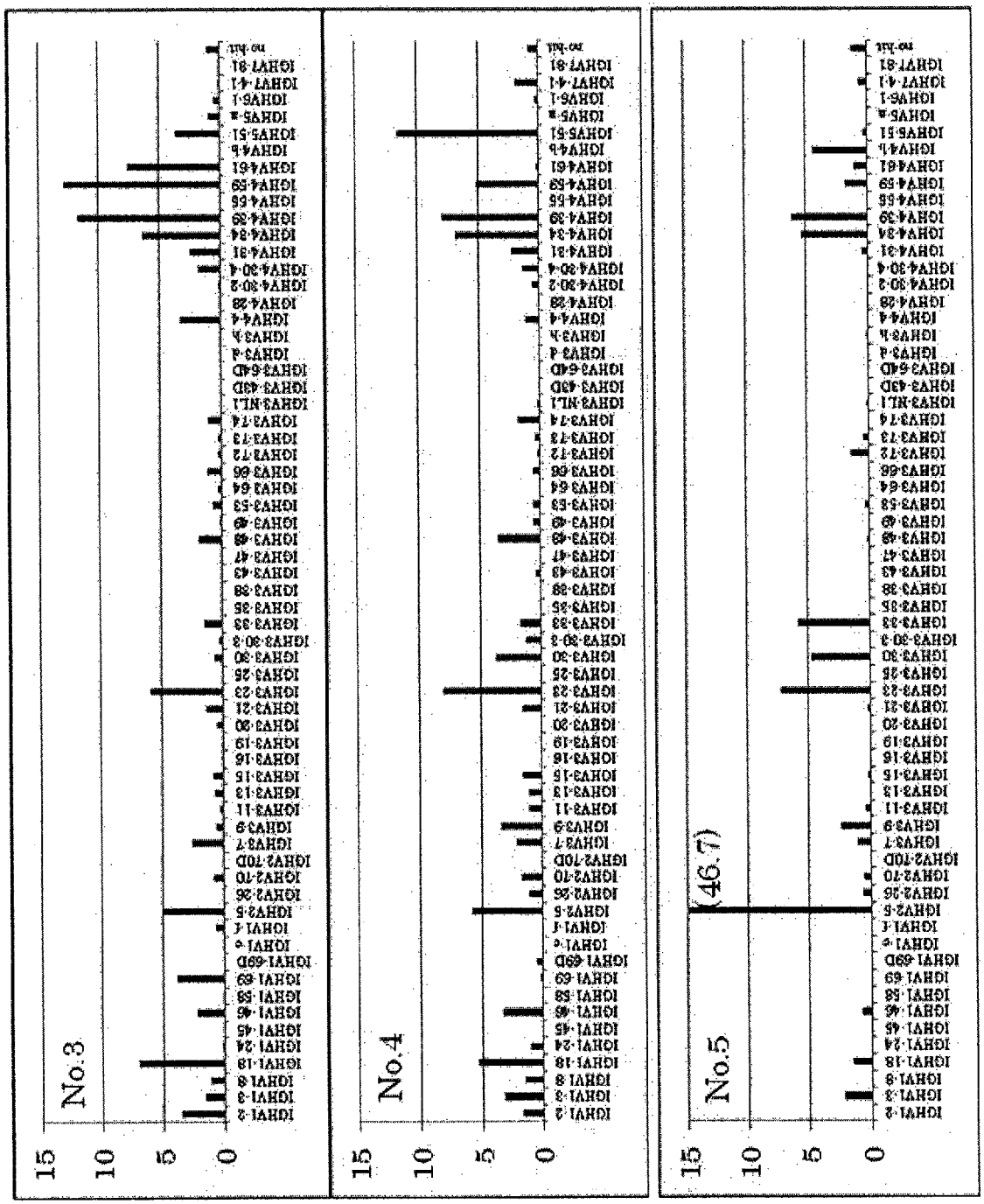
Figure 37:
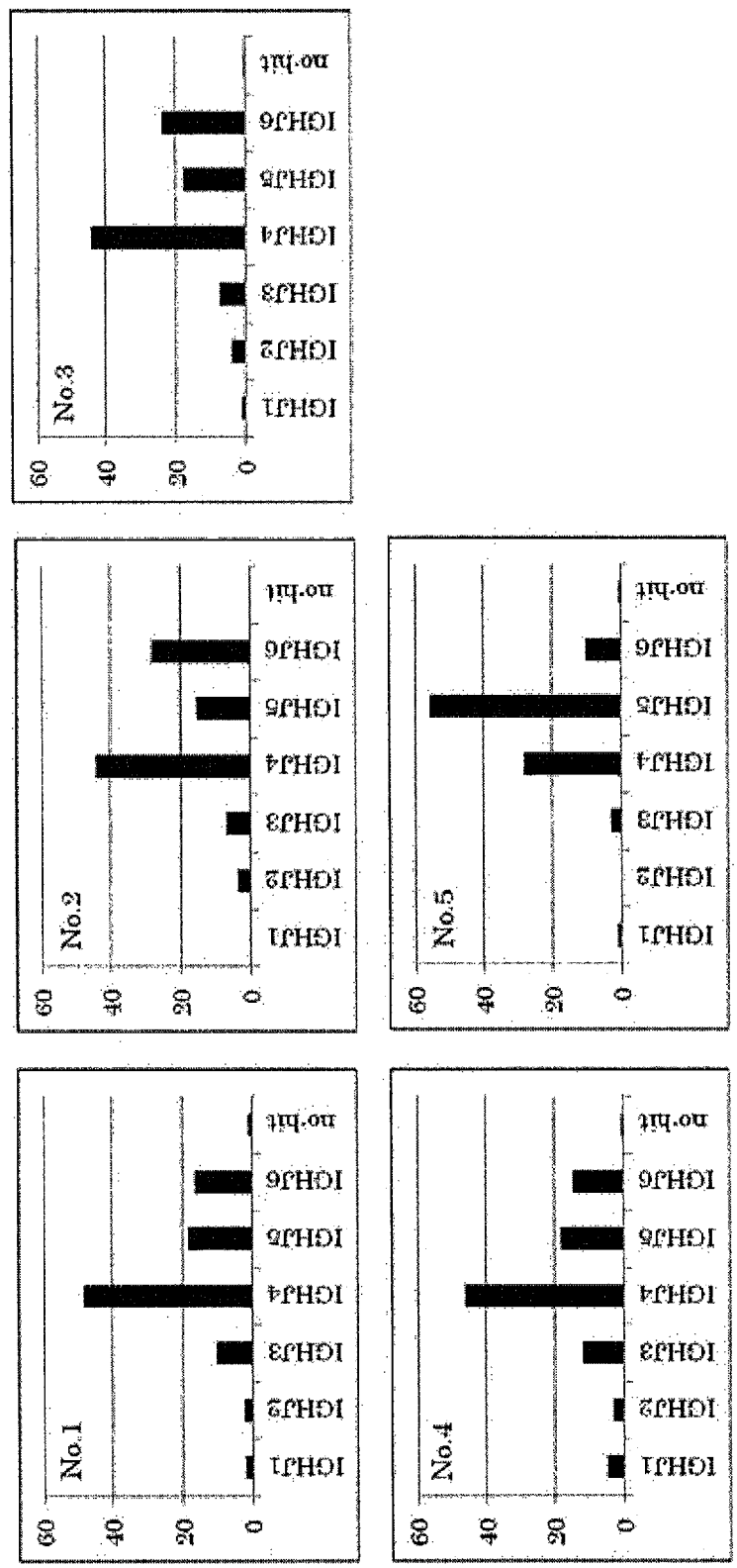
FIG. 37 is a diagram showing a comparison of IgM J repertoires among specimens. The vertical axis indicates the frequency (%) and the horizontal axis indicates the gene names. No-hit indicates a frequency of genes that do not fall under any gene.
Figure 38A:
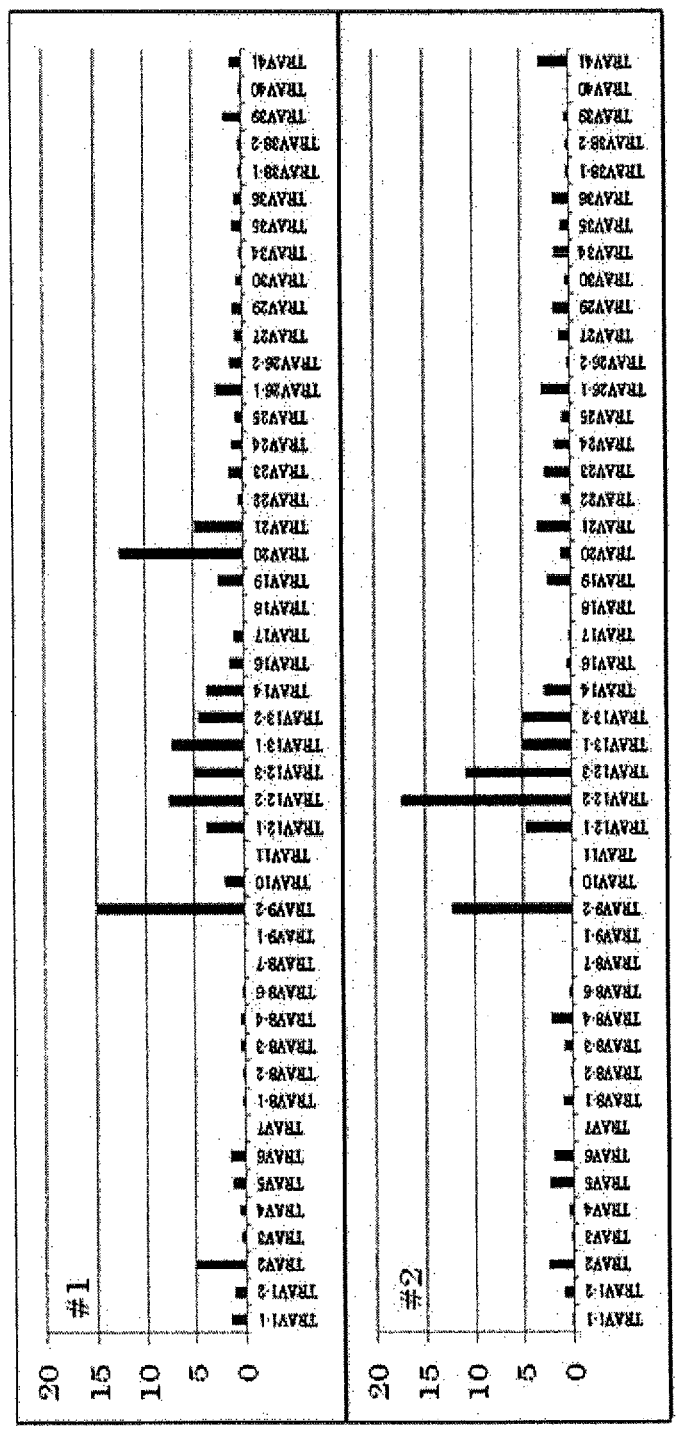
FIG. 38 (A-D) show a comparison of TRAV repertoires among specimens. The vertical axis indicates the frequency (%) and the horizontal axis indicates the gene names. "Mean" is the mean of all specimens and the error bar indicates the ±standard deviation.
Figure 38B:
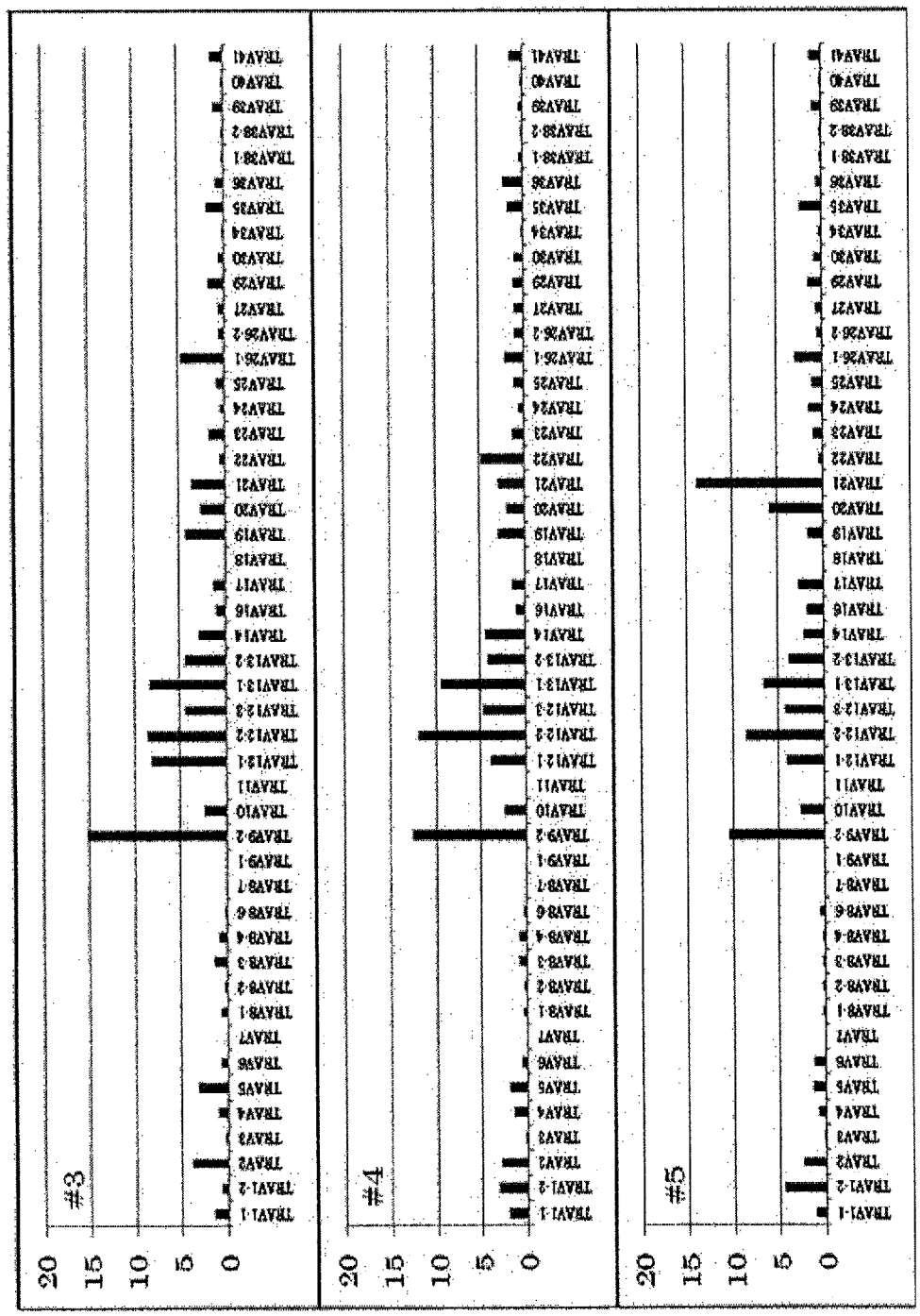
Figure 38C:
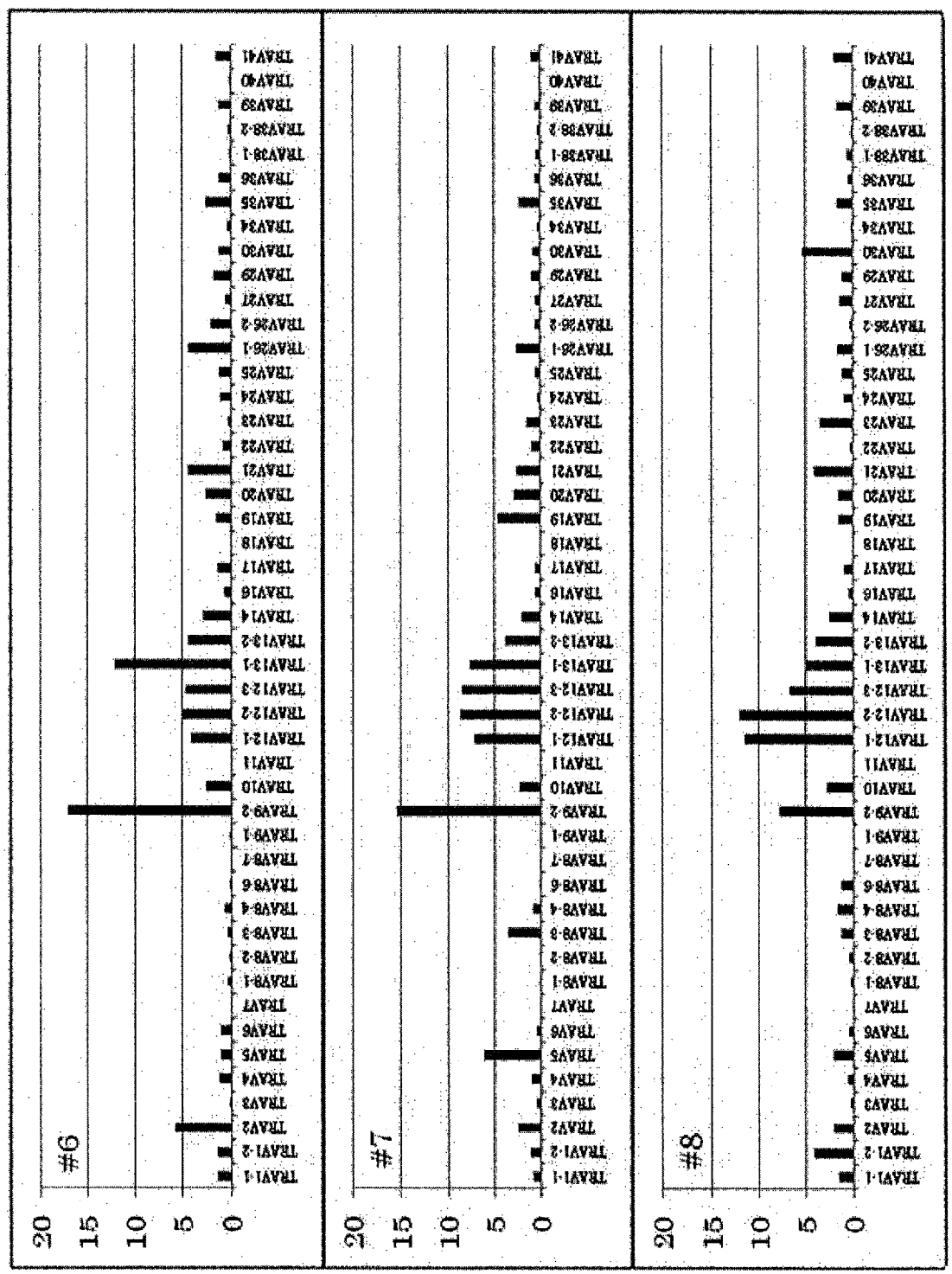
Figure 38D:
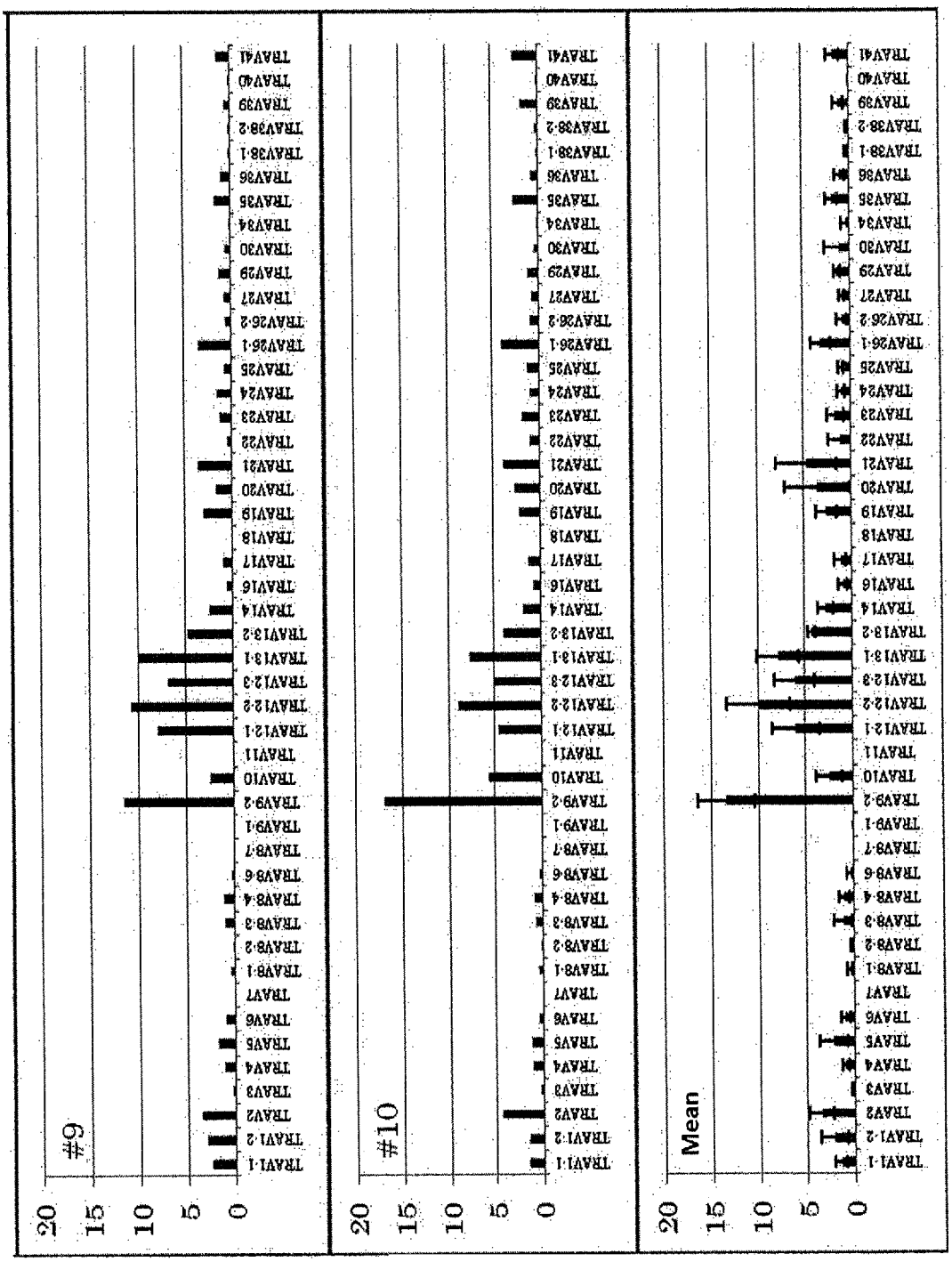
Figure 39A:
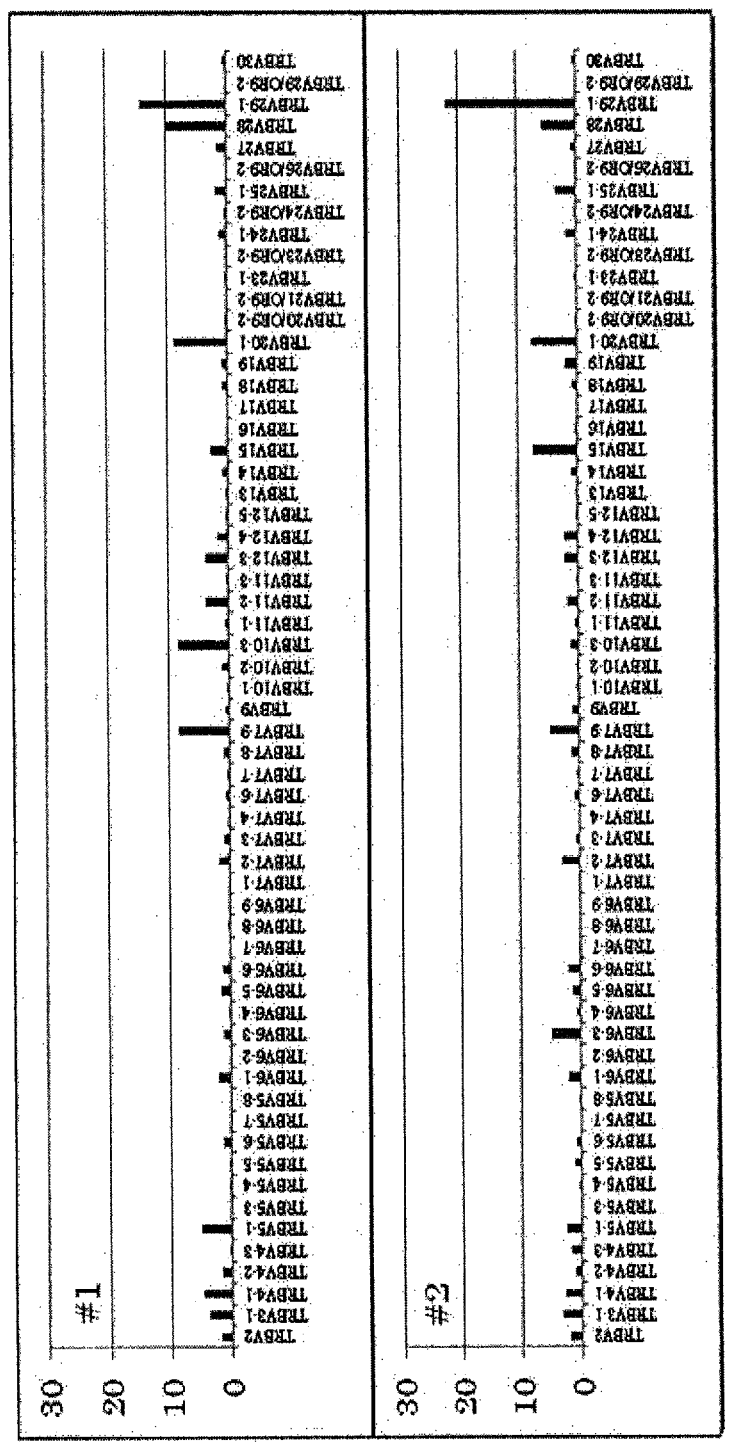
FIG. 39 (A-D) show a comparison of TRBV repertoires among specimens. The vertical axis indicates the frequency (%) and the horizontal axis indicates the gene names. "Mean" is the mean of all specimens and the error bar indicates the ±standard deviation.
Figure 39B:
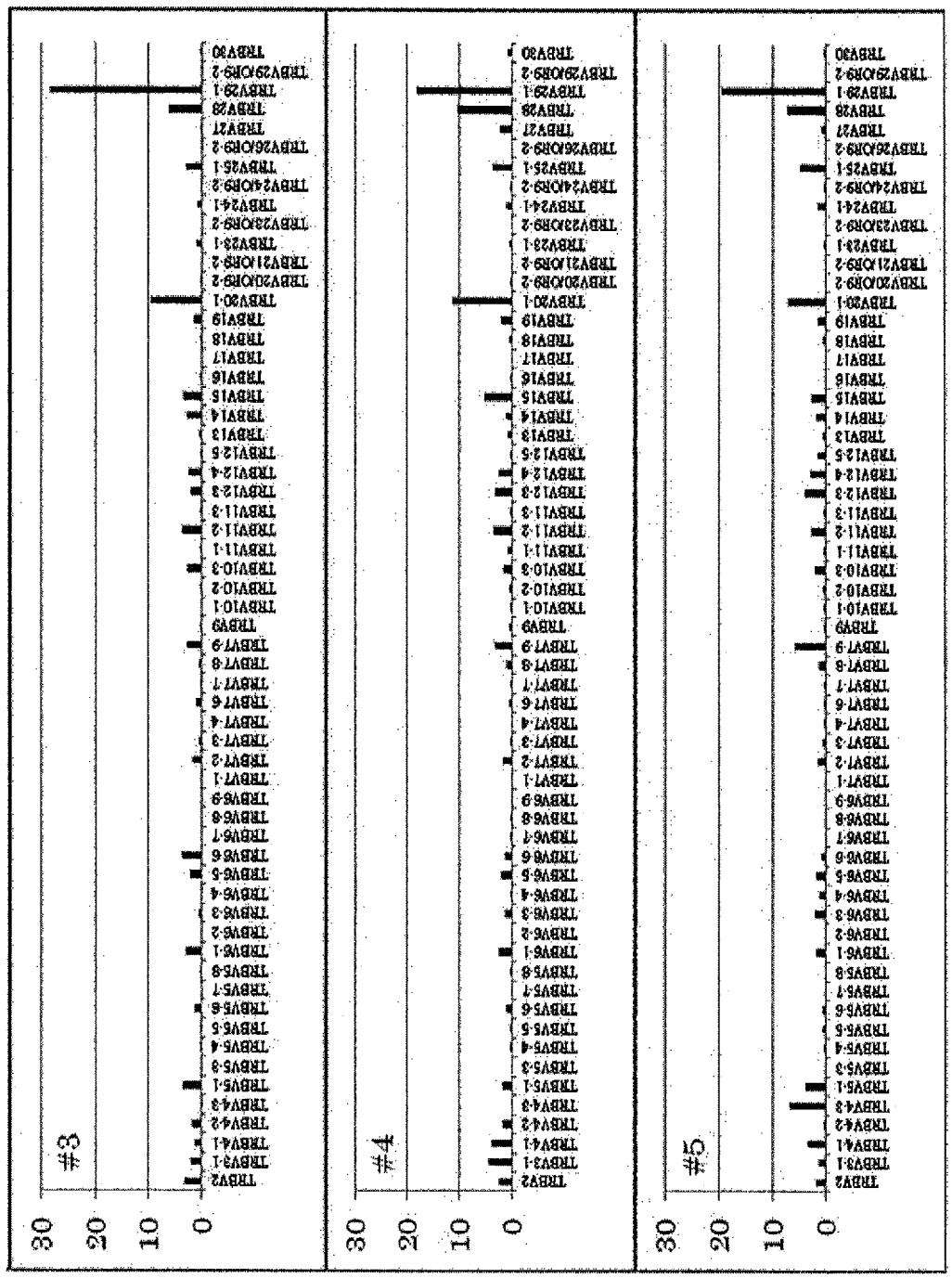
Figure 39C:
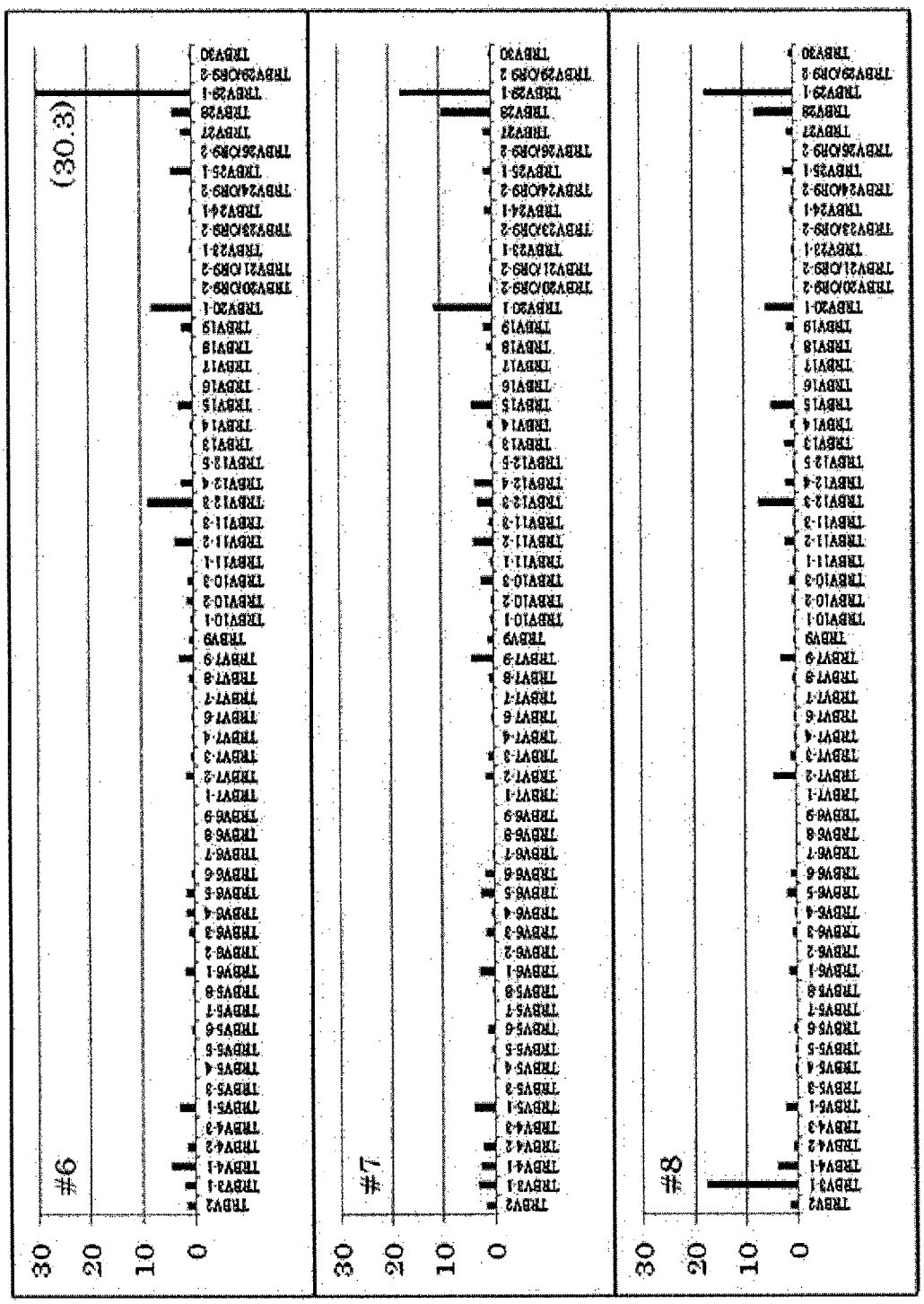
Figure 39D:
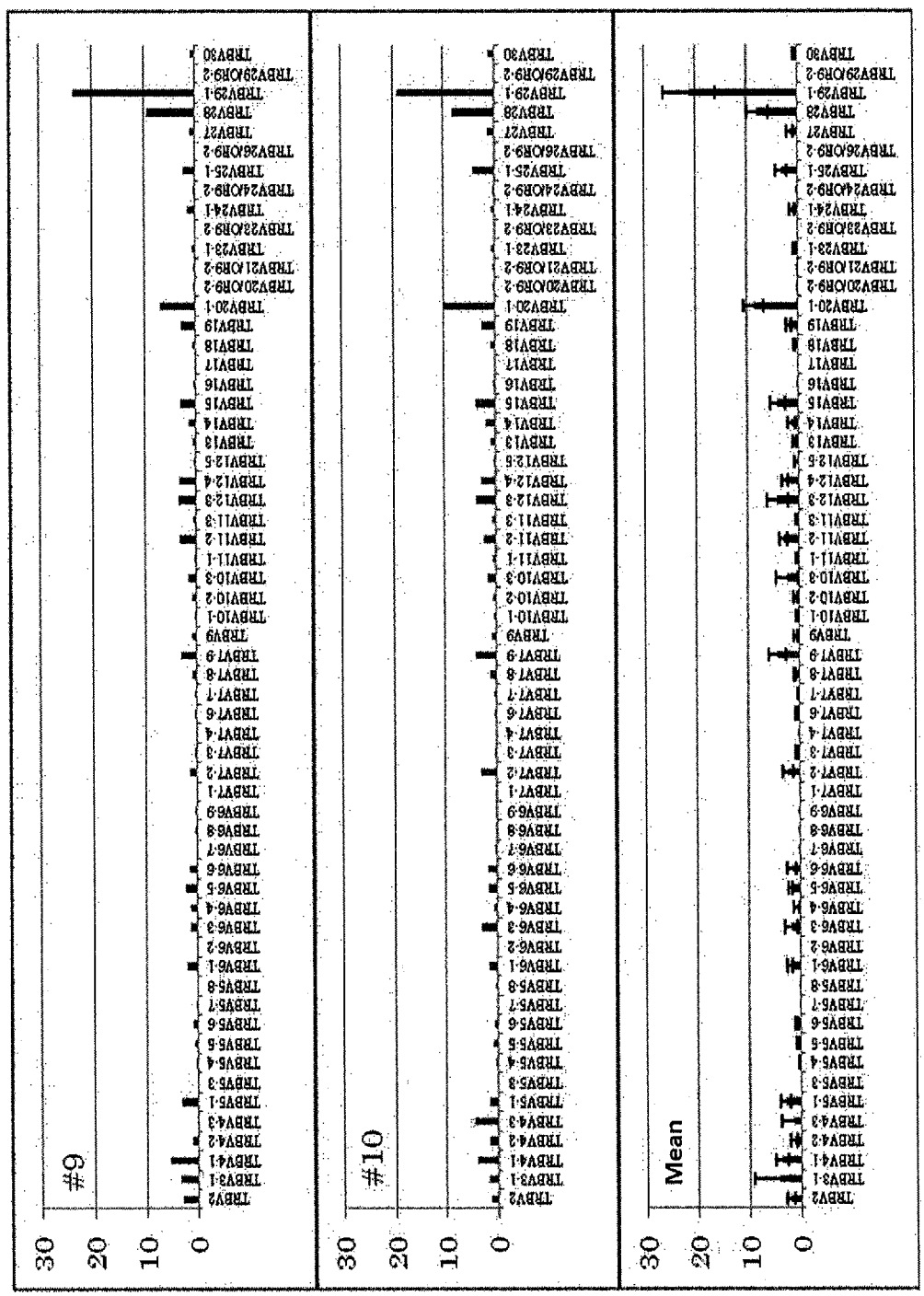
Figure 40A:
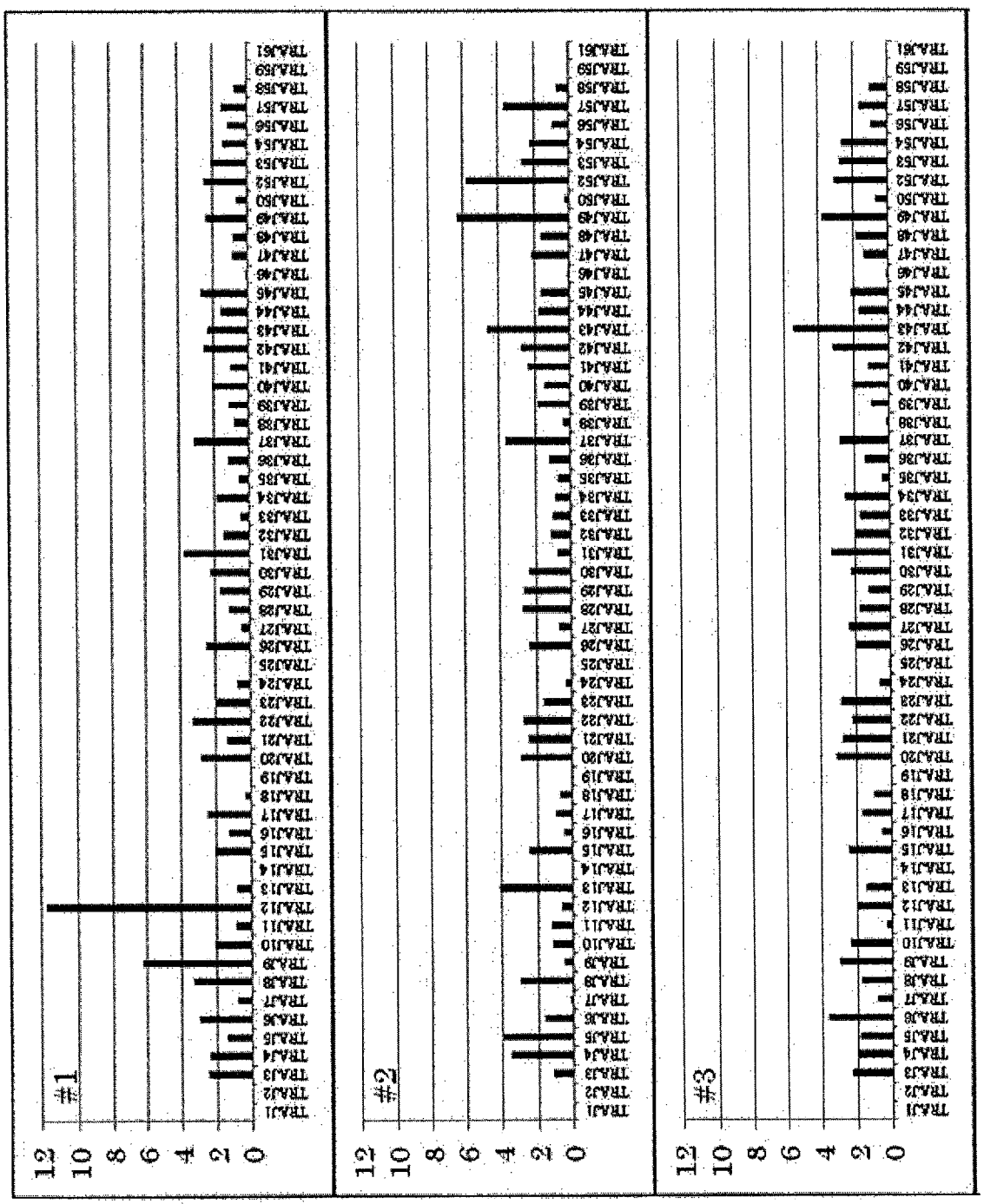
FIG. 40 (A-D) show a comparison of TRAJ repertoires among specimens. The vertical axis indicates the frequency (%) and the horizontal axis indicates the gene names. "Mean" is the mean of all specimens and the error bar indicates the ±standard deviation.
Figure 40B:
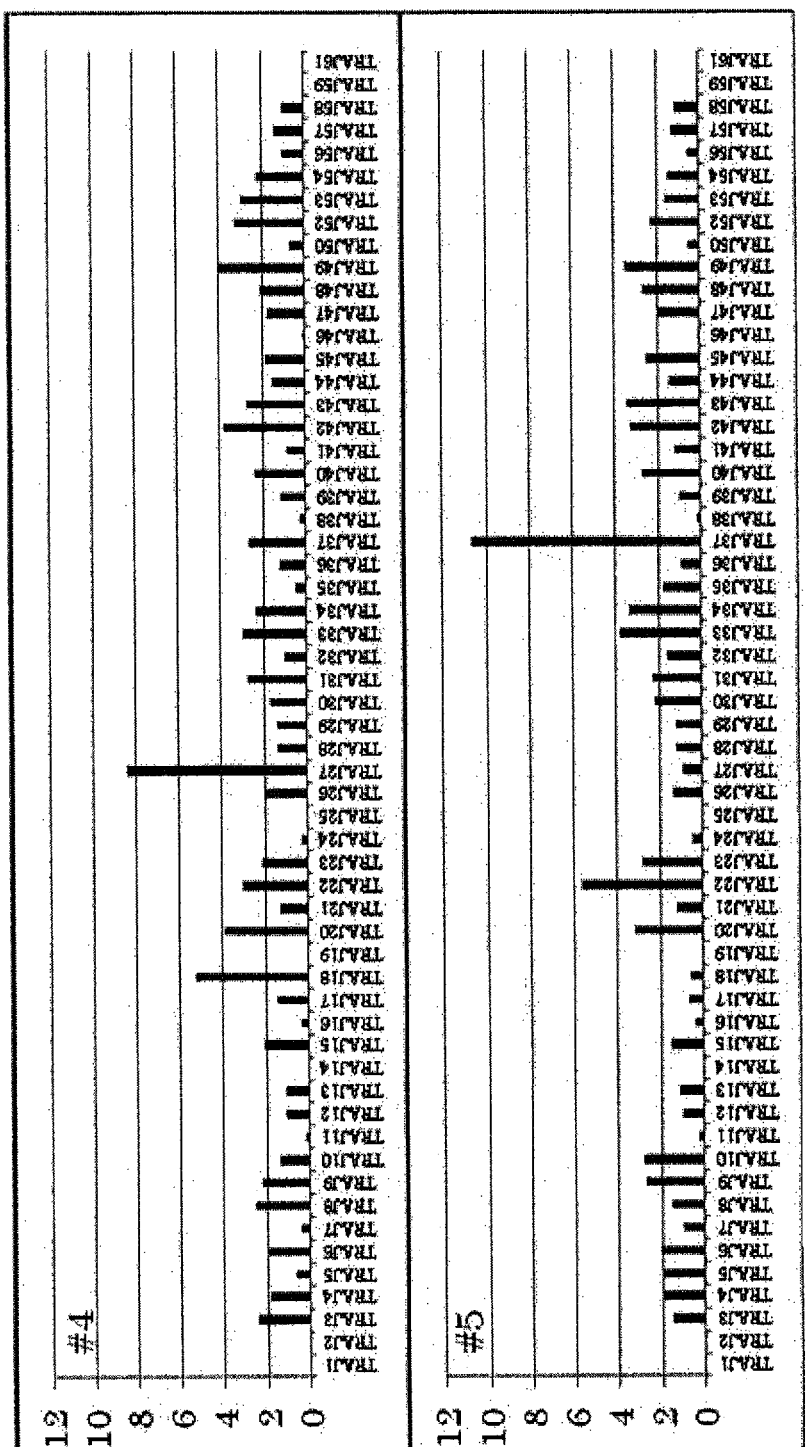
Figure 40C:
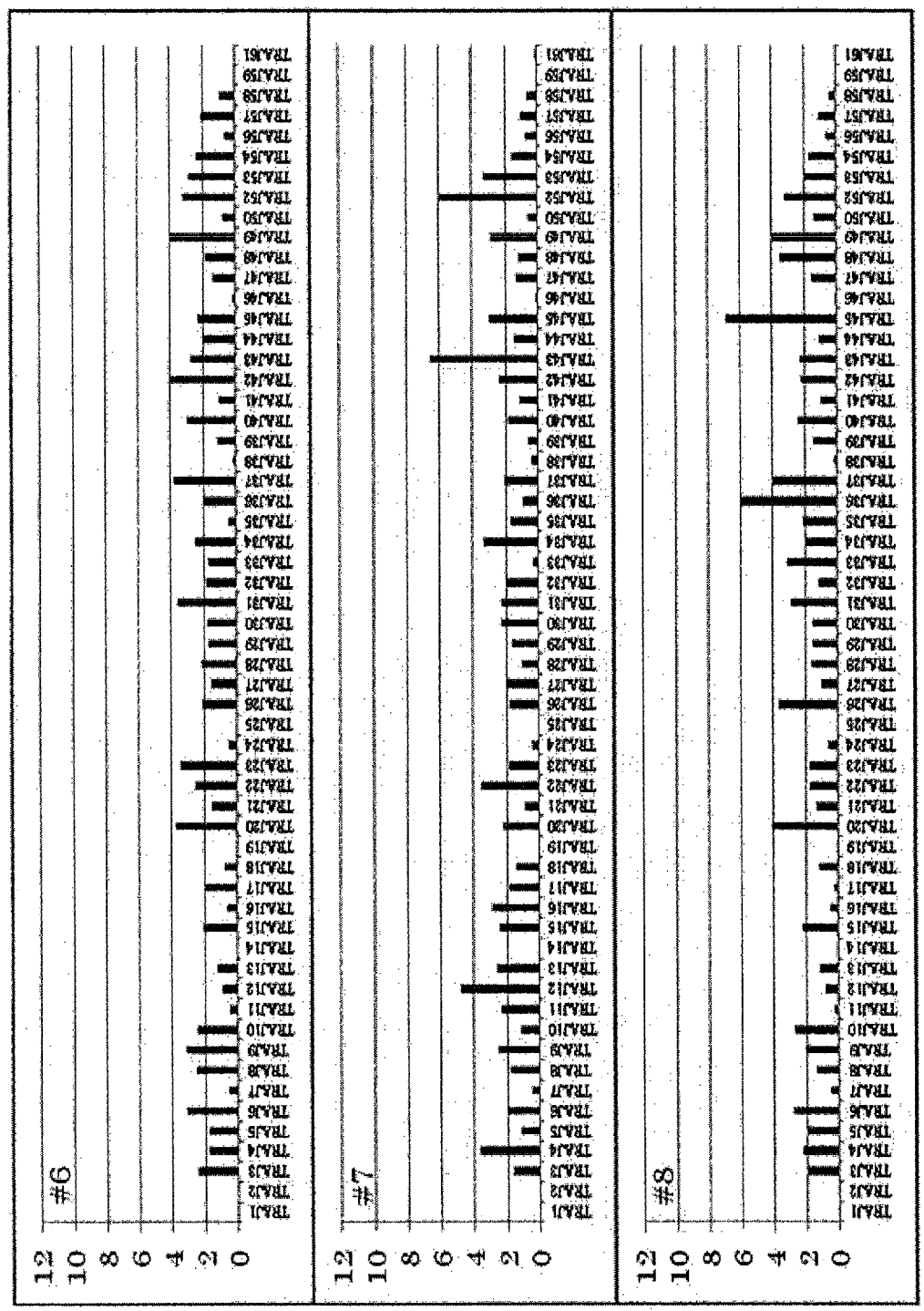
Figure 40D:
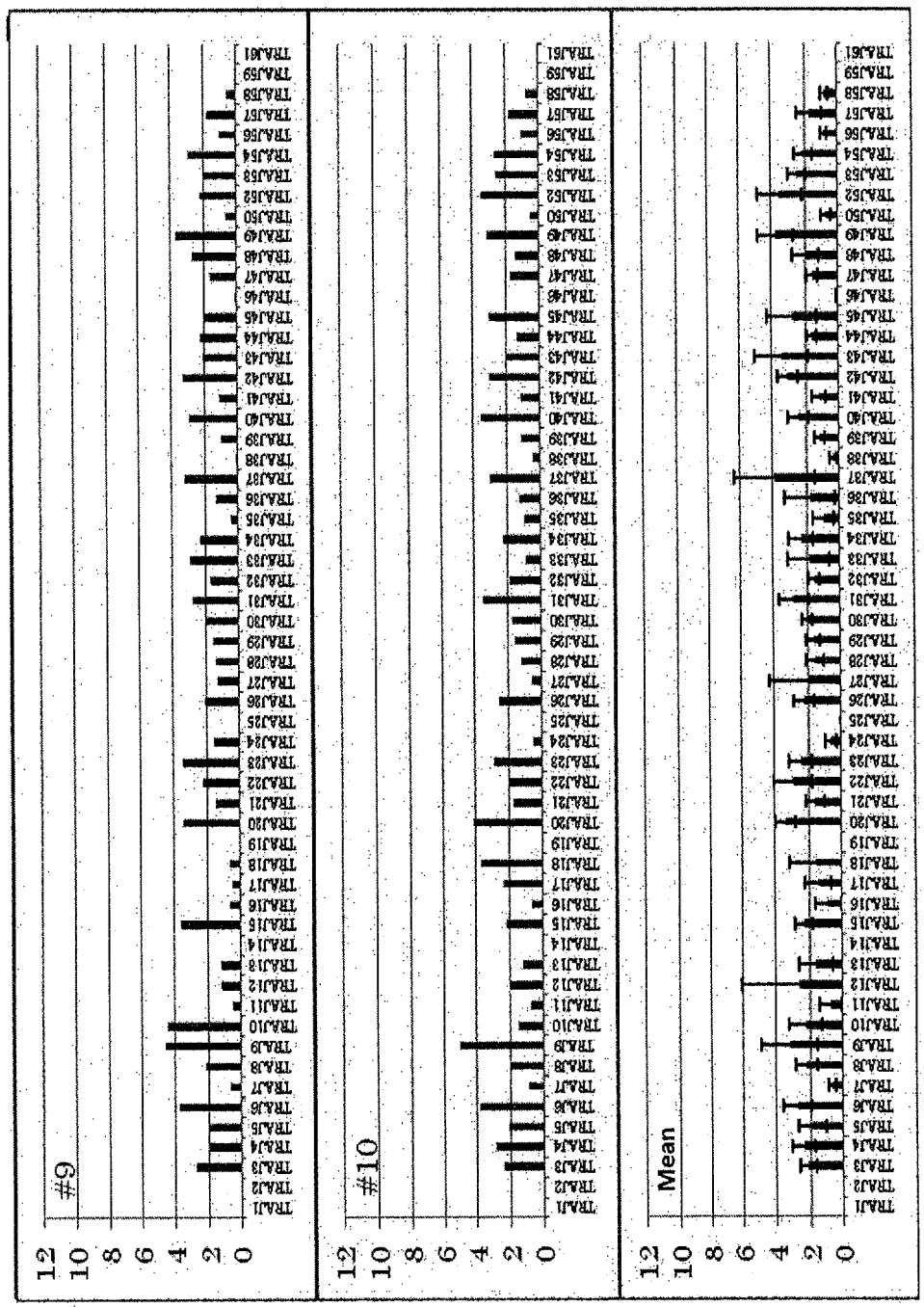

The present Example compared BCR repertoires among specimens.
(Materials and Methods)
(Materials)
For a read set of 5 specimens obtained by the same technology as Analysis Example 1, 4 specimens (No. 1-4) are healthy individuals and one specimen (No. 5) is a leukemia patient.
(Method)
A repertoire was derived out for each class and each region for each sample by the same method as Analysis Example 1 and compared among specimens.
(Results)
As an example of results, FIG. 36 (A and B) show results of comparing V repertoires in IgM and FIG. 37 shows results of comparing J repertoires. It is demonstrated that only specimen No. 5 is significantly different.

Analytical Test Example 3

Comparison of TCR Repertoires of Healthy Individuals

Figure 41:
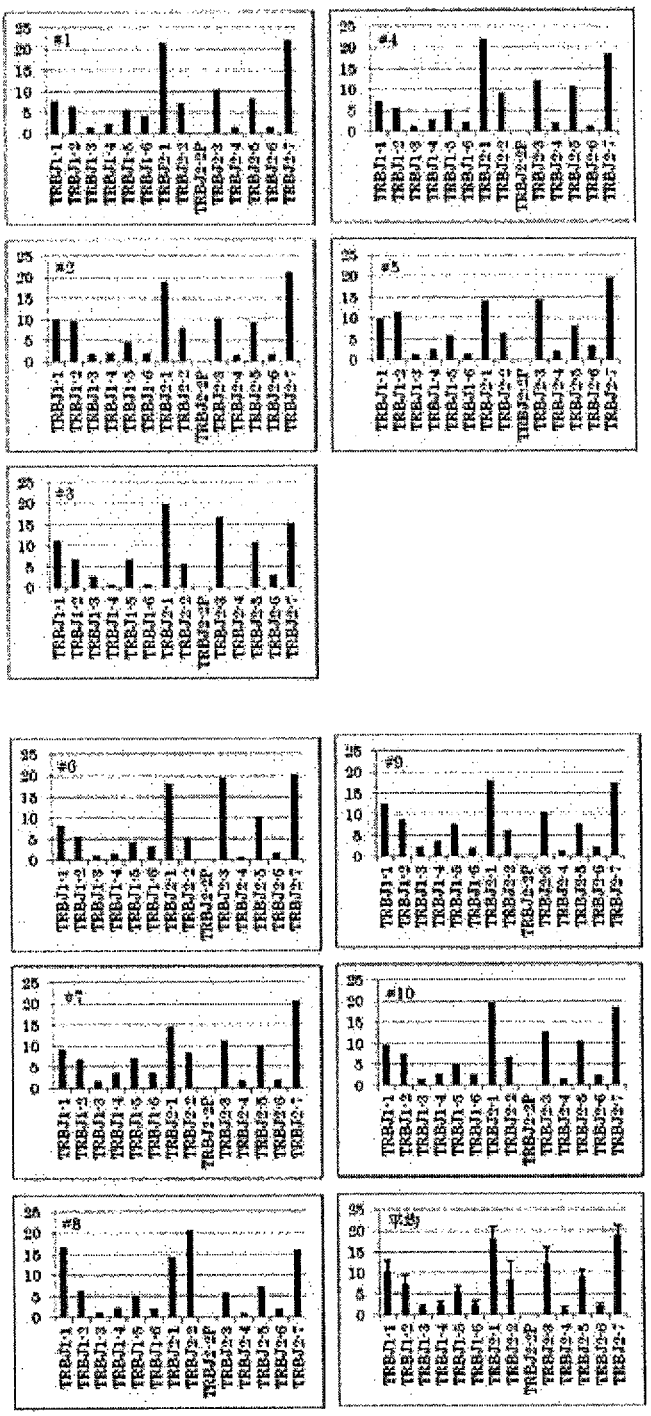
FIG. 41 shows a comparison of TRBJ repertoires among specimens. The vertical axis indicates the frequency (%) and the horizontal axis indicates the gene names. "Mean" is the mean of all specimens and the error bar indicates the ±standard deviation.

The present Example compared TCR repertoires of healthy individuals.
(Materials and Methods)
(Materials)
For a read set of 10 specimens obtained by the same technology as Example 1, 10 specimens (No. 1-10) are all healthy individuals.
(Methods)
A repertoire was derived out for each class and each region for each sample by the same method as Example 1 and compared among specimens.
(Results)
Results are shown in FIGS. 38-41. FIG. 38 (A-D) show results of comparing TRAV repertoires among specimens. FIG. 39 (A-D) show results of comparing TRBV repertoires among specimens. FIG. 40 (A-D) show results of comparing TRAJ repertoires among specimens. FIG. 41 shows result of comparing TRBJ repertoires among specimens.

Each of the results was able to be obtained in about several minutes.

The present analysis method can materialize analysis of a C region, which was not provided by High-V-QUEST that has been commonly used. The advantage of the present system includes that "unit of gene name" or "unit of allele" can be selected for each region. Although not wishing to be bound by any theory, this is because such a selection is not materialized with High-V-QUEST that has been commonly used. The (current) issue in High-V-QUEST method is in insufficient classification of D regions, while the present system can be considered as solving such an issue. Specifically, database content for a D region is insufficient in High-V-QUEST, and therefore D region sequences that are not similar to a DB record would all be swept under "no hit". In contrast, the system of the present system can utilize a CDR3 sequence instead of a D gene name/allele as a classification category. Thus, classification as far as currently possible can be performed. The present system can be used without any limit in the number of sequences. Although not wishing to be bound by any theory, this is due to consideration such that further deep sequencing to search for a rare clone, when performed, can be analyzed without any change. Instead, a feature of limiting the number of analysis jobs processed simultaneously (when full, automatically processed later), i.e., a job queue style management function, is introduced to prevent depletion of computational resources. The disadvantage of High-V-QUEST, which has a limited number of maximum sequences, is overcome thereby.

EXAMPLES OF ANALYSIS SYSTEM

Example 1 of Analysis System

Diagnostic Application in T-Cell Large Granular Lymphocyte Leukemia (T-LGL)

The present invention performed an experiment to confirm application of the system of the present invention in diagnosis of T-cell large granular lymphocyte leukemia (T-LGL).

Sample: Peripheral blood mononuclear cells derived from T-cell large granular lymphocyte leukemia Method (RNA Extraction)

7 mL of whole blood was collected from one patient suffering from T-cell large granular lymphocyte leukemia in a heparin-containing blood collection tube. Peripheral blood mononuclear cells (PBMC) were separated by ficoll density gradient centrifugation. Total RNA was extracted/purified from the isolated $1.66 \times 10^7$ PBMCs by using an RNeasy Lipid Tissue Mini Kit (QIAGEN, Germany). The resulting RNA was quantified by absorbance of A260 bp using an absorption spectrometer. The amount of total RNA was 15 µg.

(Synthesis of Complementary DNA and Double Stranded Complementary DNA)

The extracted RNA sample was used to carry out an adaptor-ligation PCR. First, in order to synthesize a complementary DNA, a BSL-18E primer (Table 3-1A) and 3.5 µL of RNA were admixed and annealed for 8 minutes at 70° C. After cooling on ice, a reverse transcription reaction was performed in the presence of an RNase inhibitor (RNAsin) to synthesize a complementary DNA with the following composition.

TABLE 3-1A

Synthesis of complementary DNA

| Reagent | Content (µL) | Final concentration |
|---|---|---|
| RNA solution | 3.5 | |
| 200 µM BSL-18E | 1.5 | 30 µM |
| | Total 5 | 70° C., 8 minutes |
| 5x First strand buffer | 2 | 50 mM Tris-HCl, pH 8.3, 75 mM KCl, 3 mM MgCl$_2$ |
| 0.1M DTT | 1 | 10 mM |
| 10 mM dNTPs | 0.5 | 500 µM |
| RNasin (Promega) | 0.5 | 2 U/µL |
| Superscript III ™, 200 U/µL (Invitrogen) | 1 | 20 U/µL |

The complementary DNA was subsequently incubated for hours at 16° C. in the following double-stranded DNA synthesis buffer in the presence of *E. coli* DNA polymerase I, *E. coli* DNA Ligase, and RNase H to synthesize a double stranded complementary DNA. Furthermore, T4 DNA polymerase was reacted for 5 minutes at 16° C. to perform a 5' terminal blunting reaction.

TABLE 3-1B1

Synthesis of complementary double stranded DNA

| Reagent | Content (µL) | Final concentration |
|---|---|---|
| Complementary DNA reaction solution | 9 | |
| Sterilized water | 46.5 | |
| 5x Second strand buffer | 15 | 25 mM Tris-HCl, pH 7.5, 100 mM KCl, 5 mM MgCl$_2$, 10 mM (NH$_4$)SO$_4$, 0.15 mM β-NAD+, 1.2 mM DTT |
| 10 mM dNTPs | 1.5 | 0.2 mM |
| *E. coli* DNA ligase, 10 U/µL (Invitrogen) | 0.5 | 0.067 U/µL |
| *E. coli* DNA polymerase, 10 U/µL (Invitrogen) | 2 | 0.27 U/µL |
| RNaseH, 2 U/µL (Invitrogen) | 0.5 | 0.013 U/µL |
| | Total 75 µL | 16° C., 2 hours |
| T4 DNA polymerase, 5 U/µL (Invitrogen) | 1 | 0.067 U/µL |
| | | 16° C., 5 minutes |

A double stranded DNA, after column purification by a High Pure PCR Cleanup Micro Kit (Roche), was incubated all night at 16° C. in the presence of a P20EA/10EA adaptor (Table 3-1A) and T4 ligase in the following T4 ligase buffer for a ligation reaction.

TABLE 3-1C

Adaptor adding reaction

| Reagent | Content (µL) | Final concentration |
|---|---|---|
| Complementary double stranded DNA solution | 12.5 | |
| T4 ligase buffer | 5 | 50 mM Tris-HCl, pH 7.6, 10 mM MgCl$_2$, 1 mM ATP, 5% PEG5000, 1 mM DTT |
| 50 µM P20EA/10EA adaptor | 5 | 10 µM |
| T4 DNAリガーゼ, 1 U/µL (Invitrogen) | 2.5 | 0.1 U/µL |
| | Total 25 | 16° C., all night |

An adaptor added double stranded DNA purified similarly by a column as discussed above was digested by a NotI restriction enzyme (50 U/µL, Takara) with the following composition in order to remove an adaptor added to the 3' terminal.

TABLE 3-1D1

Restriction enzyme treatment

| Reagent | Content (µL) | Final concentration |
|---|---|---|
| Complementary double stranded DNA solution | 34 | |
| 10x restriction enzyme buffer | 5 | 50 mM Tris-HCl, pH 7.5, 10 mM MgCl$_2$, 1 mM, 1 mM DTT, 100 mM NaCl |
| 0.1% BSA | 5 | 0.01% |
| 0.1% Triton X-100 | 5 | 0.01% |
| NotI, 50 U/µL (Takara) | 1 | 1 U/µL |
| | Total 50 | 37° C., 2 hours |

3. PCR

The 1$^{st}$ PCR amplification was performed by using a common adaptor primer P20EA and a TCRα chain or β chain C region specific primer (CA1 or CB1) from a double stranded complementary DNA. 20 cycles of PCR were performed, where a cycle was 30 seconds at 95° C., 30 seconds at 55° C., and one minute at 72° C. with the composition shown below.

TABLE 3-1E

1st PCR amplification reaction composition

| | Content (μL) | Final concentration |
|---|---|---|
| 2x ExTaq Premix (Takara) | 10 | 10 mM Tris-HCl (pH 8.3) 50 mM KCl 2 mM MgCl$_2$ 0.2 mM dNTPs 0.5 U ExTaq polymerase |
| 10 mM P20EA primer | 0.5 | 250 nM |
| 10 mM CA1 or CB1 primer | 0.5 | 250 nM |
| Double stranded complementary DNA | 2 | |
| Sterilized water | 7 | |

A 1st PCR amplicon was then used to perform 2nd PCR with the reaction composition shown below by using a P20EA primer and a TCRα chain or β chain C region specific primer (CA2 or CB2). 20 cycles of PCR were performed, where a cycle was 30 seconds at 95° C., 30 seconds at 55° C., and one minute at 72° C.

TABLE 3-1F1

2nd PCR amplification reaction composition

| | Content (μL) | Final concentration |
|---|---|---|
| 2x ExTaq Premix (Takara) | 10 | 10 mM Tris-HCl (pH 8.3) 50 mM KCl 2 mM MgCl$_2$ 0.2 mM dNTPs |

TABLE 3-1F2

| | | 0.5 U ExTaq polymerase |
|---|---|---|
| 10 mM P20EA primer | 1 | 500 nM |
| 10 mM CA2 or CB2 primer | 1 | 500 nM |
| 1st PCR amplicon | 2 | |
| Sterilized water | 6 | |

A primer was removed from the obtained 2 PCR amplicon by a High Pure PCR Cleanup Micro Kit (Roche). Furthermore, analysis was carried out with Roche's next generation sequence analyzer (GS Junior Bench Top system), with the 2nd PCR amplicon diluted 10 fold as a template. Amplification utilized a B-P20EA primer, which is a P20EA adaptor primer added with an adaptor B sequence, and HuVaF-01-HuVaF10 (α chain) and HuVbF-01-HuVbF-10 (β chain), which are a TCRα chain or β chain C region specific primer added with an adaptor A sequence and each MID Tag sequence (MID-1 to 26). 10 cycles of PCR were performed, where a cycle was 30 seconds at 95° C., 30 seconds at 55° C., and one minute at 72° C.

TABLE 3-1G

3rd PCR amplification reaction composition

| | Content (μL) | Final concentration |
|---|---|---|
| 2x ExTaq Premix (Takara) | 10 | 10 mM Tris-HCl (pH 8.3) 50 mM KCl 2 mM MgCl$_2$ 0.2 mM dNTPs 0.5 U ExTaq polymerase |
| 10 mM B-P20EA primer | 1 | 500 nM |
| 10 mM HuVaF or HuVbF) primer | 1 | 500 nM |
| 2nd PCR amplicon | 1 | |
| Sterilized water | 7 | |

In agarose gel electrophoresis, a band comprising about 600 bp of amplicon was cut out, when visualized, and purified by using a DNA purification kit (QIAEX II Gel Extraction Kit, Qiagen). The amount of DNA from the collected PCR amplicon was measured by using a Quant-T™ PicoGreen® dsDNA Assay Kit (Invitrogen).

4. Next Generation Sequencing

Next generation sequencing was carried out with Roche's GS Junior sequence analyzer. Specifically, a GS Junior Titanium emPCR Kit (Lib-L) was used to carry out emPCR in accordance with the protocol of the manufacturer at the ratio of beads to DNA (copy per beads: cpb) of 0.5. After emPCR, a sequence run was carried out for the beads collected with beads enrichment by using sequence run reagents GS Junior Titanium Sequencing Kit and PicoTiter-Plate Kit in accordance with the protocol of the manufacturer.

5. Data Analysis

The resulting sequence data (SFF file) was classified into read sequences for each MID Tag to create a sequence file in a Fasta format by a software that comes with GS Junior (sfffile or sffinfo). For sequence read analysis, V, D, J, and C sequences of each read sequence were assigned by using V, D, J, and C sequences obtained from the IMGT (the international ImMunoGeneTics information system, www dot imgt dot org) database as reference sequences. The newly developed software (Repertoire Genesis) was used for the assignment. 22,833 reads were obtained and 16,407 reads (71.9%) were assigned for TCR.alpha. The number of unique reads was 1705 reads. 121,080 reads were obtained and 81,542 reads (67.3%) were assigned for TCR.beta. The number of unique reads was 9,224. The frequency of the obtained reads was studied, with a read having the same TRAV gene, TRAJ gene and CDR3 sequence as a unique read (Table 3-1). Similarly, the frequency was studied for a read with the same TRBV gene TRBJ gene, and CDR3 sequence (Table 3-2). As a result, 1971 reads (12.53%) accounted for a read with TRAV10, TRAJ15 and CVVRATGTALIFG (SEQ ID NO: 1450) for a TRA repertoire, suggesting the possibility that a cell expressing a specific TCR has increased clonality. Further, 22568 reads (28.57%) accounted for reads with TRBV29-1, TRBJ2-7, and CSVERGGSLGEQYFG (SEQ ID NO: 1500) in a TRB repertoire. The results suggest the possibility of monoclonal increase in T cells expressing a TCR molecule consisting of TCR.alpha. having TRAV10 and TRAJ15 and TCR having TRBV29-1 and TRBJ2-7. Various diversity indices were compared among 10 healthy individuals and LGL patients (Table 3-3). The Shannon-Weaver's index (H'), Simpson's index (.lamda.), Inverse Simpson's index (1/.lamda.), and Pielou's index (J') indicating diversity were exhibiting a lower value compared to healthy individuals, demonstrating reduced diversity.

6. Utility in Diagnosis

It is expected that a minor residual lesion can be detected with a sequence read having TRAV10/TRAJ15/CVVRATGTALIFG (SEQ ID NO: 1450) or TRBV29-1/TRBJ2-7/CSVERGGSLGEQYFG (SEQ ID NO: 1500) as an indicator after applying therapy such as drug therapy in the LGL patients. Further, it is understood that a therapeutic effect on leukemia cells can be measured from quantitative analysis using read frequencies. Further, the possibility of being able to predict the presence of a clonality increasing disease by using various diversity indices was suggested.

TABLE 3-1

TRA read (top 50) (SEQ ID NOs: 1450-1499)

| SEQ ID NO: | Rank | TRAV | TRAJ | CDR3 | Reads | % Reads | frame* |
|---|---|---|---|---|---|---|---|
| 1450 | 1 | TRAV10 | TRAJ15 | CVVRATGTALIFG | 1971 | 12.53 | |
| 1451 | 2 | TRAV13-2 | TRAJ5 | CAEGGTRAGEHLLL | 380 | 2.42 | out |
| 1452 | 3 | TRAV12-1 | TRAJ5 | CVAYTGRRALTFG | 337 | 2.14 | |
| 1453 | 4 | TRAV26-1 | TRAJ54 | CIVLIQGAQKLVFG | 328 | 2.08 | |
| 1454 | 5 | TRAV2 | TRAJ33 | CAVNMDSNYQLIWG | 300 | 1.91 | |
| 1455 | 6 | TRAV2 | TRAJ37 | CAVETRGNTGKLIFG | 293 | 1.86 | |
| 1456 | 7 | TRAV10 | TRAJ43 | CVVSGPYNNDMRFG | 277 | 1.76 | |
| 1457 | 8 | TRAV2 | TRAJ12 | CAVAVVDSSYKLIFG | 272 | 1.73 | |
| 1458 | 9 | TRAV1-1 | TRAJ23 | CAGFYNQGGKLTFG | 263 | 1.67 | |
| 1459 | 10 | TRAV2 | TRAJ17 | CAVEDRAAGNKLTFG | 263 | 1.67 | |
| 1460 | 11 | TRAV9-2 | TRAJ41 | CALSSTNSGYALNFG | 255 | 1.62 | |
| 1461 | 12 | TRAV9-2 | TRAJ27 | CALRGNTNAGKSTFG | 242 | 1.54 | |
| 1462 | 13 | TRAV10 | TRAJ10 | CVVSARYSREEETNSPL | 241 | 1.53 | out |
| 1463 | 14 | TRAV13-2 | TRAJ58 | CAENSRTSGSRLTFG | 236 | 1.50 | |
| 1464 | 15 | TRAV9-2 | TRAJ5 | CALSWDTGRRALTFG | 234 | 1.49 | |
| 1465 | 16 | TRAV10 | TRAJ43 | CVVTTVDDMRFG | 223 | 1.42 | |
| 1466 | 17 | TRAV1-2 | TRAJ22 | CSLSGSARQLTFG | 322 | 1.41 | |
| 1467 | 18 | TRAV12-3 | TRAJ48 | CAMRPFGNEKLTFG | 219 | 1.39 | |
| 1468 | 19 | TRAV9-2 | TRAJ32 | CALYGGATNKLIFG | 218 | 1.39 | |
| 1469 | 20 | TRAV12-3 | TRAJ39 | CAMSEGNAGNMLTFG | 216 | 1.37 | |
| 1470 | 21 | TRAV9-2 | TRAJ6 | CALSPLSGGSYIPTFG | 206 | 1.31 | |
| 1471 | 22 | TRAV12-1 | TRAJ9 | CVVRKYWRLQNYLW | 181 | 1.15 | out |
| 1472 | 23 | TRAV9-2 | TRAJ4 | CALRFLPGGGYNKLIFG | 180 | 1.14 | |
| 1473 | 24 | TRAV9-2 | TRAJ32 | CALVPRRGATNKLIFG | 176 | 1.12 | |
| 1474 | 25 | TRAV13-1 | TRAJ20 | CAADDYKLSFG | 172 | 1.09 | |
| 1475 | 26 | TRAV35 | TRAJ53 | CANSGGSNYKLTFG | 166 | 1.06 | |
| 1476 | 27 | TRAV6 | TRAJ27 | CALDGNACKSTFG | 165 | 1.05 | |
| 1477 | 28 | TRAV13-1 | TRAJ39 | CAASSSGGNMLTFG | 162 | 1.03 | |
| 1478 | 29 | TRAV9-2 | TRAJ13 | CALIGGYQKVTFG | 162 | 1.03 | out |
| 1479 | 30 | TRAV9-2 | TRAJ43 | CAIRVTCAL | 162 | 1.03 | |
| 1480 | 31 | TRAV2 | TRAJ9 | CAVVEGTGGFKTIFG | 158 | 1.00 | |
| 1481 | 32 | TRAV9-2 | TRAJ21 | CALGLMGNFNKFYFG | 155 | 0.99 | |
| 1482 | 33 | TRAV2 | TRAJ9 | CAVDRNTGGFKTIFG | 153 | 0.97 | |

TABLE 3-1-continued

TRA read (top 50) (SEQ ID NOs: 1450-1499)

| SEQ ID NO | Rank | TRAV | TRAJ | CDR3 | Reads | % Reads | frame* |
|---|---|---|---|---|---|---|---|
| 1483 | 34 | TRAV13-1 | TRAJ36 | CAASRGANNLFFG | 147 | 0.93 | |
| 1484 | 35 | TRAV9-2 | TRAJ41 | CALRPNSNSGYALNFG | 146 | 0.93 | |
| 1485 | 36 | TRAV9-2 | TRAJ23 | CALNYNQGGKLIFG | 144 | 0.92 | |
| 1486 | 37 | TRAV9-2 | TRAJ43 | CAGNNNDMRFG | 139 | 0.88 | |
| 1487 | 38 | TRAV12-2 | TRAJ20 | CAVSNDYKLSFG | 135 | 0.86 | |
| 1488 | 39 | TRAV12-2 | TRAJ48 | CAVPFGNEKLTFG | 134 | 0.85 | |
| 1489 | 40 | TRAV6 | TRAJ22 | CALGASGSARQLTFG | 128 | 0.01 | |
| 1490 | 41 | TRAV9-2 | TRAJ39 | CALSDRAGNMLTFG | 127 | 0.81 | |
| 1491 | 42 | TRAV20 | TRAJ44 | CATHTGTASKLTFG | 124 | 0.79 | |
| 1492 | 43 | TRAV9-2 | TRAJ6 | CALPPSGGSYIPTFG | 124 | 0.79 | |
| 1493 | 44 | TRAV10 | TRAJ27 | CVVSPLTNAGKSTFG | 118 | 0.75 | |
| 1494 | 45 | TRAV9-2 | TRAJ27 | CATRRGTPMQANQPL | 117 | 0.74 | out |
| 1495 | 46 | TRAV2 | TRAJ40 | CAVETSYSGTYKYIFG | 116 | 0.74 | |
| 1496 | 47 | TRAV26-1 | TRAJ44 | CIVRSHTTGTASKETFG | 114 | 0.72 | |
| 1497 | 48 | TRAV9-2 | TRAJ8 | CASLFQKLVEG | 105 | 0.67 | out |
| 1498 | 49 | TRAV38-2 | TRAJ54 | CAYRSENSGSPEAGIW | 104 | 0.66 | |
| 1499 | 50 | TRAV21 | TRAJ33 | CAVTFGDSNYQLIWG | 103 | 0.65 | |

*out: out-of-frame

TABLE 3-2

TRB read (top 50)

| SEQ ID NO: | Rank | TRAV | TRAJ | CDR3 | Reads | % Reads | frame* |
|---|---|---|---|---|---|---|---|
| 1500 | 1 | TRBV29-1 | TRBJ2-7 | CSVERGGSLGEQYFG | 22568 | 28.57 | |
| 1501 | 2 | TRBV20-1 | TRBJ2-7 | CSARTLAGHYEQYFG | 5609 | 7.10 | |
| 1502 | 3 | TRBV7-9 | TRBJ2-7 | CASSTFGTGNHEQYFG | 809 | 1.02 | |
| 1503 | 4 | TRBV29-1 | TRBJ2-7 | CSVERGGSLGGAVLR | 770 | 0.97 | out |
| 1504 | 5 | TRBV29-1 | TRBJ2-5 | CSANPGQQLQETQYFG | 573 | 0.73 | |
| 1505 | 6 | TRBV29-1 | TRBJ2-7 | CSVEREAPLGSSTS | 571 | 0.72 | out |
| 1506 | 7 | TRBV29-1 | TRBJ2-7 | CSVERGGSLGEQTS | 542 | 0.69 | out |
| 1507 | 8 | TRBV29-1 | TRBJ2-7 | CSVEERKGEQYFG | 514 | 0.65 | |
| 1508 | 9 | TRBV15 | TRBJ2-5 | CATSRDGQQETQYFG | 510 | 0.65 | |
| 1509 | 10 | TRBV29-1 | TRBJ2-7 | CSARTGDYYEQYFG | 486 | 0.62 | |
| 1510 | 11 | TRBV1-2 | TRBJ2-1 | CASSLAGGSYNEQFFG | 465 | 0.59 | |
| 1511 | 12 | TRBV29-1 | TRBJ2-7 | CSVSETGLYEQYFG | 460 | 0.58 | |
| 1512 | 13 | TRBV20-1 | TRBJ2-7 | CSASRGLAGGSYEQYFG | 446 | 0.56 | |
| 1513 | 14 | TRBV20-1 | TRBJ2-7 | CSARTXRDIQQYFG | 435 | 0.55 | out |
| 1514 | 15 | TRBV29-1 | TRBJ2-3 | CSALAGVGDTQYFG | 427 | 0.54 | out |
| 1515 | 16 | TRBV29-1 | TRBJ2-7 | CSVERGRLPWGSSTS | 426 | 0.54 | |

TABLE 3-2-continued

TRB read (top 50)

| SEQ ID NO: | Rank | TRAV | TRAJ | CDR3 | Reads | % Reads | frame* |
|---|---|---|---|---|---|---|---|
| 1516 | 17 | TRBV29-1 | TRBJ2-1 | CSVEVLAGGPNEQFFG | 425 | 0.54 | |
| 1517 | 18 | TRBV29-1 | TRBJ2-1 | CSVTGTSGRATTSPSSYNEQFFG | 424 | 0.54 | |
| 1518 | 19 | TRBV29-1 | TRBJ2-6 | CSVATGGDGANVLTFG | 384 | 0.49 | |
| 1519 | 20 | TRBV29-1 | TRBJ2-7 | CSVGGLRDRPSYEQYFG | 381 | 0.48 | |
| 1520 | 21 | TRBV29-1 | TRBJ2-3 | CSQIEGDTQYFG | 378 | 0.48 | |
| 1521 | 22 | TRBV12-3 | TRBJ2-7 | CASSQTVYEQYFG | 371 | 0.47 | |
| 1522 | 23 | TRBV29-1 | TRBJ2-7 | CSAVEARKSSYEQYFG | 357 | 0.45 | |
| 1523 | 24 | TRBV29-1 | TRBJ2-3 | CSVCACAGGTDTQYFG | 343 | 0.43 | |
| 1524 | 25 | TRBV29-1 | TRBJ2-7 | CSVERGRLPWGAVLR | 312 | 0.39 | out |
| 1525 | 26 | TRBV6-6 | TRBJ2-5 | CASTSSETQYFG | 311 | 0.39 | |
| 1526 | 27 | TRBV29-1 | TRBJ2-7 | CSVERGGSLGSSTS | 300 | 0.38 | out |
| 1527 | 28 | TRBV10-3 | TRBJ1-6 | CATSETPTSNNPHSSYNSPLHFG | 280 | 0.35 | |
| 1528 | 29 | TRBV28 | TRBJ1-1 | CASMVGPANTEAFFG | 277 | 0.35 | |
| 1529 | 30 | TRBV4-1 | TRBJ2-7 | CASSQYLISYEQYFG | 275 | 0.35 | |
| 1530 | 31 | TRBV29-1 | TRBJ2-1 | CSVGGVSSYNEQFFG | 274 | 0.35 | |
| 1531 | 32 | TRBV15 | TRBJ1-5 | CATSTQKNQPQHFG | 270 | 0.34 | |
| 1532 | 33 | TRBV29-1 | TRBJ2-5 | CSVEAGVGETQYFG | 270 | 0.34 | |
| 1533 | 34 | TRBV20-1 | TRBJ1-2 | CSARFGVGYGYTFG | 260 | 0.33 | |
| 1534 | 35 | TRBV19 | TRBJ2-1 | CASRHTAGEVNEQFFG | 254 | 0.32 | |
| 1535 | 36 | TRBV15 | TRBJ1-1 | CATSRDRQSDTEAFFG | 250 | 0.32 | |
| 1536 | 37 | TRBV20-1 | TRBJ1-1 | CSARDQTAEAFFG | 244 | 0.31 | |
| 1537 | 38 | TRBV9 | TRBJ1-2 | CASSVAARPYGYTFG | 244 | 0.31 | |
| 1538 | 39 | TRBV25-1 | TRBJ1-3 | CASSEVREALETPYIE | 241 | 0.31 | out |
| 1539 | 40 | TRBV28 | TRBJ1-5 | CASTQNYAQPQHFG | 238 | 0.30 | |
| 1540 | 41 | TRBV15 | TRBJ2-1 | CATSGQGKTYNEQFFG | 237 | 0.30 | out |
| 1541 | 42 | TRBV5-1 | TRBJ1-4 | CASSYTGTGDENCFW | 236 | 0.30 | |
| 1542 | 43 | TRBV20-1 | TRBJ1-1 | CSPEEAFFG | 226 | 0.29 | |
| 1543 | 44 | TRBV14 | TRBJ1-3 | CASSQDFRSVSGNTIYFG | 225 | 0.26 | |
| 1544 | 45 | TRBV7-3 | TRBJ2-3 | CASSLAGGVDTQYFG | 221 | 0.26 | |
| 1545 | 46 | TRBV27 | TRBJ2-7 | CASSGTSGRYEQYFG | 220 | 0.26 | |
| 1546 | 47 | TRBV29-1 | TRBJ2-1 | CSVVSWQVLDKSSSS | 214 | 0.27 | out |
| 1547 | 48 | TRBV4-1 | TRBJ2-3 | CASSRPGQGLTQYFG | 207 | 0.26 | out |
| 1548 | 49 | TRBV29-1 | TRBJ2-7 | CSVERGGSLGXQYFG | 206 | 0.26 | |
| 1549 | 50 | TRBV4-3 | TRBJ2-7 | CASSQERGKYEQYFG | 202 | 0.26 | |

*out: out-of-frame

TABLE 3-3

Diversity index

| Diversity | TCR α | | | | TCR β | | | |
| | LGL | Healthy individuals (n = 10) | | | LGL | Healthy individuals (n = 10) | | |
| index | | Mean | Maximum | Minimum | | Mean | Maximum | Minimum |
| --- | --- | --- | --- | --- | --- | --- | --- | --- |
| H' | 5.0 | 7.5 | 6.3 | 8.4 | 5.3 | 7.1 | 6.0 | 8.0 |
| 1 − λ | 0.976 | 0.997 | 0.990 | 1.000 | 0.912 | 0.996 | 0.983 | 1.000 |
| 1/λ | 41.1 | 975.1 | 103.2 | 4042.0 | 11.4 | 883.8 | 58.7 | 2711.5 |
| J | 0.7 | 0.9 | 0.9 | 1.0 | 0.6 | 0.9 | 0.9 | 1.0 |

Figure 44:
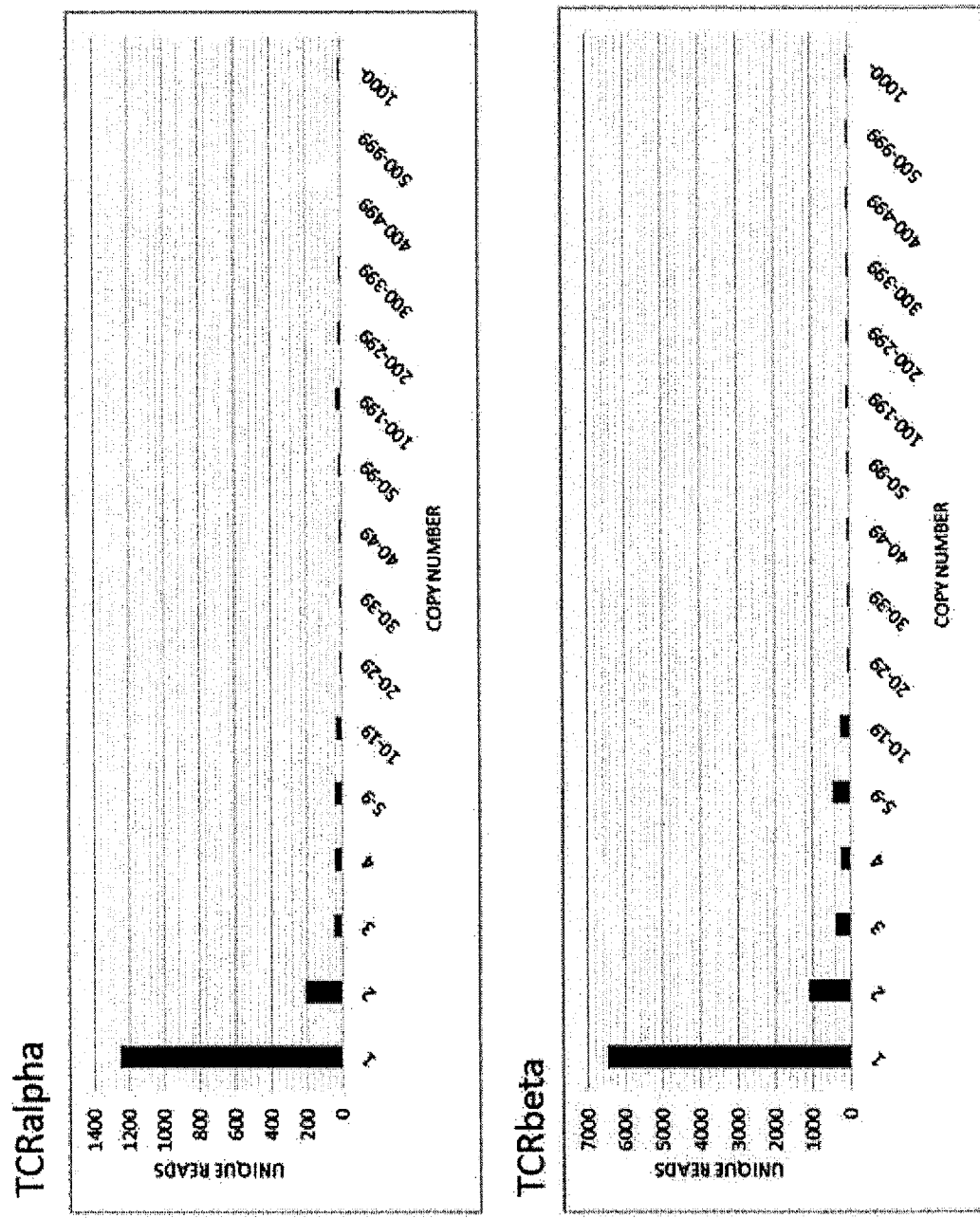
FIG. 44 shows a distribution of the number of unique reads in TCRα and TCRβ chain repertoire analysis. The distribution was examined for unique reads (base sequence without commonality with other reads) of all sequence reads, with the number of copies in the horizontal axis. A read that was only detected once (single) was 73.3% (1250 reads) of the whole for TCRα, and 70.5% (6502 reads) for a TCR chain.

H': Shannon-Wiener's diversity index,
λ: Simpson's diversity index,
1/λ: Inverse Simpson's diversity index,
J: Pielou's evenness index FIG. 44 shows a distribution of the number of unique reads in TCRα and TCRβ chain repertoire analysis. The distribution was examined for unique reads (base sequence without commonality with other reads) of all sequence reads, with number of copies in the horizontal axis. A read that was only detected once (single) was 73.3% (1250 reads) of the whole for TCRα, and 70.5% (6502 reads) for a TCRβ chain.

Figure 45:
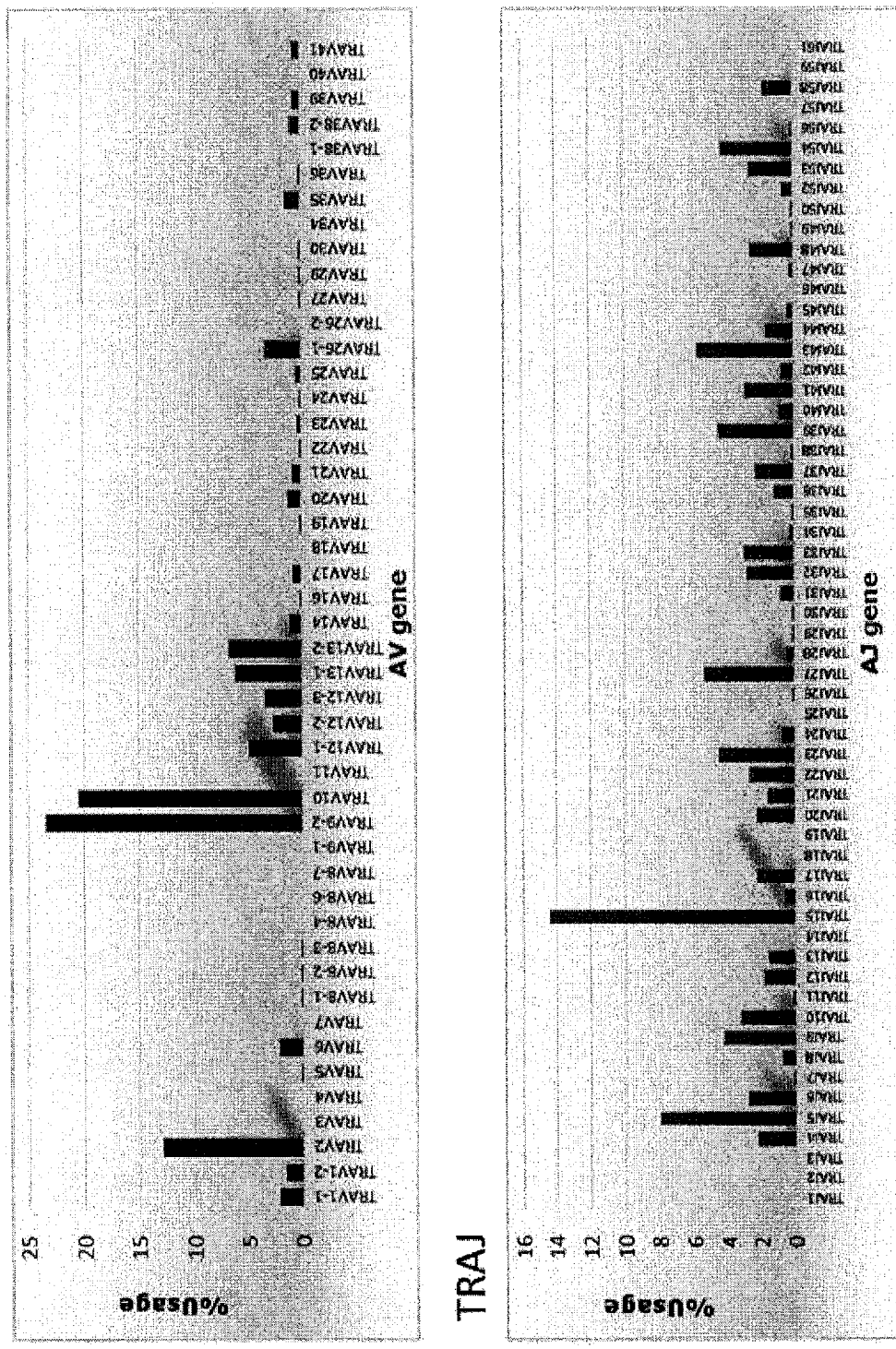
FIG. 45 shows TRAV and TRAJ repertoires. The usage frequency of each of TRAV and TRAJ in all reads is shown. The horizontal axis indicates TRAV genes (top graph) and TRAJ genes (bottom graph). The vertical axis indicates the percentage (% Usage) accounted for among all reads.

FIG. 45 shows TRAV and TRAJ repertoires. The usage frequency of each of TRAV and TRAJ in all reads is shown. The horizontal axis indicates TRAV genes (top graph) and TRAJ genes (bottom graph). The vertical axis indicates the percentage (% Usage) accounted for among all reads.

Figure 46:
FIG. 46 shows a 3D plot of a TRA repertoire. Usage frequency of each combination of TRAV and TRAJ in all reads is shown in a three-dimensional plot. The horizontal axis indicates a TRAJ gene, the depth axis indicates a TRAV gene, and the vertical axis indicates usage frequency (% Usage). The combination of TRAV10 and TRAJ15 exhibited the highest usage frequency (12.53%).
Figure 47:
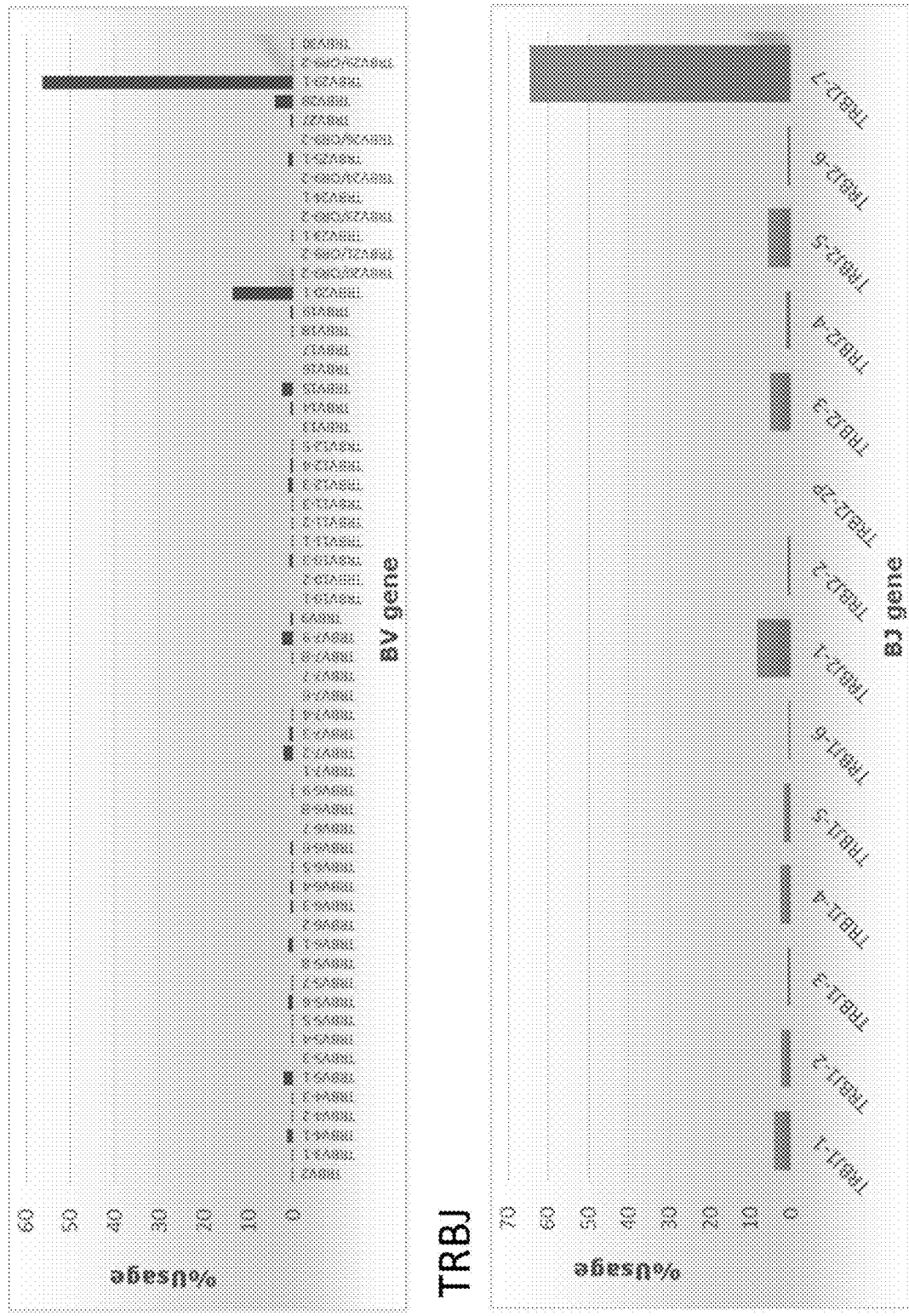
FIG. 47 shows TRBV and TRBJ repertoires. The usage frequency of each of TRBV and TRBJ in all reads is shown. The horizontal axis indicates TRBV genes (top graph) and TRBJ genes (bottom graph). The vertical axis indicates the percentage (% Usage) accounted for among all reads.

FIG. 46 shows a 3D plot of a TRA repertoire. Usage frequency of each combination of TRAV and TRAJ in all reads is shown in a three-dimensional plot. The horizontal axis indicates a TRAJ gene, the depth axis indicates a TRAV gene, and the vertical axis indicates usage frequency (% Usage). The combination of TRAV10 and TRAJ15 exhibited the highest usage frequency (12.53%). FIG. 47 shows TRBV and TRBJ repertoires. The usage frequency of each of TRBV and TRBJ in all reads is shown. The horizontal axis indicates TRBV genes (top graph) and TRBJ genes (bottom graph). The vertical axis indicates the percentage (% Usage) accounted for among all reads.

Figure 48:
FIG. 48 shows a 3D plot of a TRB repertoire. Usage frequency of each combination of TRBV and TRBJ in all reads is shown in a three-dimensional plot. The horizontal axis indicates a TRBV gene, the depth axis indicates a TRBJ gene, and the vertical axis indicates usage frequency (% Usage). The combination of TRBV29-1 and TRBJ2-7 exhibited the highest usage frequency (28.57%).

FIG. 48 shows a 3D plot of a TRB repertoire. Usage frequency of each combination of TRBV and TRBJ in all reads is shown in a three-dimensional plot. The horizontal axis indicates a TRBV gene, the depth axis indicates a TRBJ gene, and the vertical axis indicates usage frequency (% Usage). The combination of TRBV29-1 and TRBJ2-7 exhibited the highest usage frequency (28.57%).

Example 2 of Analysis System

Analysis of T Cells Infiltrating Large Intestine Tissue of HLA-A2402 Colorectal Cancer Patients The present Example analyzed T cells infiltrating large intestine tissue of HLA-A2402 colorectal cancer patients by using the analysis system of the present invention.

(Materials and Methods)

Sample: Tumor tissue of colorectal cancer patients extracted by surgical operation, peripheral blood of healthy individuals Method (Collection and Storage of Colorectal Cancer Tissue)

Tumor tissue was collected by a tumor extraction surgery in 60 large intestine patients. 100 mg of tissue corresponding to the size of a soy bean was collected from a cancer lesion of the extracted organ. The tissue was cut into a square with a 5 mm side and immediately immersed in an RNA stabilizing agent (RNAlater®, Ambion). After storing at 4° overnight, RNAlater® was removed and then the tissue was stored at −80° C.

(Isolation of Peripheral Blood of Healthy Individuals)

As a control, peripheral blood cells of a healthy individual were used. 5 mL of whole blood was collected from 10 healthy individuals in a heparin-containing blood collection tube. Peripheral blood mononuclear cells (PBMC) were separated by ficoll density gradient centrifugation. Total RNA was extracted/purified from the isolated $5 \times 10^6$ PBMCs by using an RNeasy Lipid Tissue Mini Kit (QIAGEN, Germany). The resulting RNA was quantified by absorbance of A260 bp using an absorption spectrometer (Table 3-3A).

TABLE 3-3A

Amount of total RNA in peripheral blood cells of healthy individuals

| Sample Number | Amount of elution (μL) | RNA concentration (ng/μL) |
| --- | --- | --- |
| 1 | 30 | 1682 |
| 2 | 30 | 274 |
| 3 | 30 | 1007 |
| 4 | 30 | 560 |
| 5 | 30 | 988 |
| 6 | 30 | 1327 |
| 7 | 30 | 667 |
| 8 | 30 | 258 |
| 9 | 30 | 597 |
| 10 | 30 | 624 |

(Examination of HLA Haplotype)

HLA-A typing was carried out in order to identify the expression of HLA and HLA haplotype in cancer tissue. A part of cancer tissue immersed in RNA Later® was taken out, and a genomic DNA was extracted by using a QIAampDNA Mini Kit (Qiagen, Germany). The DNA was then amplified and labeled by using a WAKFlow HLA typing reagent HLA-A (Wakunaga) and analyzed with Luminex (Luminex Corp.) As a result, HLA-A2402 gene was expressed homo or hetero in 25 specimens out of 60 specimens (Tables 3-4).

TABLE 3-4

List of colorectal cancer tissue expressing HLA-A2402

| Number | Sex | Age | Diagnosis | Site of metastasis | Stage | HLA-A | |
|---|---|---|---|---|---|---|---|
| 1 | F | 70 | Progression in rectal cancer | | 1 | A*24:02 | A*33:03 |
| 2 | F | 30 | Progression in rectal tumor (Rs) | Lung | 3b | A*24:02 | A*11:01 |
| 5 | F | 80 | Rectal cancer (Rs) | | 2 | A*24:02 | — |
| 8 | F | 60 | Sigmoid colon cancer (progressing) | | 2 | A*24:02 | A*11:01 |
| 12 | M | 64 | Sigmoid colon cancer (progressing) | | 3a | A*24:02 | — |
| 13 | F | 75 | Sigmoid colon cancer (progressing) | | 1 | A*24:02 | A*33:03 |
| 14 | F | 68 | Cecum cancer | | 1 | A*24:02 | — |
| 16 | F | 48 | Ascending colon cancer | Liver, lymph | 4 | A*24:02 | A*02:06 |
| 25 | F | 60 | Cecum cancer | | 3a | A*24:02 | — |
| 27 | M | 79 | Rectal cancer (Rs) | | 2 | A*24:02 | A*31:01 |
| 28 | M | 60 | Rectal cancer (Rs) | Peritoneum | 3b | A*24:02 | A*11:01 |
| 29 | F | 52 | Sigmoid colon cancer | Ovary | 4 | A*24:02 | A*02:06 |
| 30 | M | 68 | Rectal cancer | | 3b | A*24:02 | A*02:01 |
| 31 | F | 72 | Sigmoid colon cancer (progressing) | | 3b | A*24:02 | A*31:01 |
| 32 | M | 79 | Sigmoid colon cancer | | 2 | A*24:02 | — |
| 34 | M | 53 | Descending colon cancer | | 2 | A*24:02 | — |
| 35 | F | 77 | Sigmoid colon cancer (progressing) | | 3a | A*24:02 | A*31:01 |
| 38 | M | 74 | Ascending colon cancer (progressing) | | 2 | A*24:02 | A*33:03 |
| 39 | F | 74 | Rectal cancer (progressing) Rs | | 3a | A*24:02 | A*26:03 |
| 41 | F | 74 | Rectal cancer (early) Ra | | 1 | A*24:02 | A*11:01 |
| 42 | F | 67 | Ascending colon cancer (progressing) | | 3a | A*24:02 | A*26:03 |
| 44 | M | 73 | Ascending colon cancer (progressing) | | 2 | A*24:02 | A*26:01 |
| 54 | M | 70 | Colon cancer (progressing) Rs | | 3a | A*24:02 | A*02:01 |
| 58 | M | 72 | Sigmoid colon cancer (early) | | 2 | A*24:02 | — |
| 59 | M | 70 | Sigmoid colon cancer (progressing) | | 2 | A*24:02 | — |

(RNA Extraction and Measurement of Amount of RNA)

In order to analyze a TCR repertoire in 25 specimens expressing a HLA-A2402 gene, a portion of tissue immersed in RNAlater® was taken out, and total RNA was extracted/purified by using an RNeasyLipidTissue Mini Kit (QIAGEN, Germany). Elution from a column was carried out with 50 µL of RNAase free-sterilized water. The amount of RNA obtained from each sample is shown in Table 3-5.

TABLE 3-5

Amount of total RNA of colorectal cancer sample

| Number | Sample number | Amount of RNA (ng/uL) |
|---|---|---|
| 1 | HGS01 | 3765 |
| 2 | HGS02 | 2570 |
| 5 | HGS03 | 3603 |
| 8 | HGS04 | 3007 |
| 12 | HGS05 | 4843 |
| 13 | HGS06 | 1382 |
| 14 | HGS07 | 4577 |
| 16 | HGS08 | 2656 |
| 25 | HGS09 | 4219 |
| 27 | HGS10 | 6053 |
| 28 | HGS11 | 2541 |
| 29 | HGS12 | 2516 |
| 30 | HGS13 | 4319 |
| 31 | HGS14 | 4126 |
| 32 | HGS15 | 5039 |
| 34 | HGS16 | 3624 |
| 35 | HGS17 | 4459 |
| 38 | HGS18 | 4561 |
| 39 | HGS19 | 4088 |
| 41 | HGS20 | 2042 |
| 42 | HGS21 | 3554 |
| 44 | HGS23 | 3851 |
| 54 | HGS28 | 1089 |
| 58 | HGS29 | 2659 |
| 59 | HGS30 | 2981 |

(Synthesis of Complementary DNA and Double Stranded Complementary DNA)

The extracted RNA sample was used to carry out an adaptor-ligation PCR. First, in order to synthesize a complementary DNA, a BSL-18E primer and 3.5 µL of RNA were admixed and annealed for 8 minutes at 70° C. After cooling on ice, a reverse transcription reaction was performed in the presence of an RNase inhibitor (RNAsin) to synthesize a complementary DNA with the following composition.

TABLE 3-1H

Synthesis of complementary DNA

| Reagent | Content (µL) | Final concentration |
|---|---|---|
| RNA solution | 3.5 | |
| 200 µM BSL-18E | 1.5 | 30 µM |
| | Total 5 | 70° C., 8 minutes |
| 5x First strand buffer | 2 | 50 mM Tris-HCl, pH 8.3, 75 mM KCl, 3 mM MgCl$_2$ |

TABLE 3-1H-continued

Synthesis of complementary DNA

| Reagent | Content (μL) | Final concentration |
|---|---|---|
| 0.1M DTT | 1 | 10 mM |
| 10 mM dNTPs | 0.5 | 500 μM |
| RNasin (Promega) | 0.5 | 2 U/μL |
| Superscript III ™, 200 U/μL (Invitrogen) | 1 | 20 U/μL |

The complementary DNA was subsequently incubated for hours at 16° C. in the following double-stranded DNA synthesis buffer in the presence of *E. coli* DNA polymerase I, *E. coli* DNA Ligase, and RNase H to synthesize a double stranded complementary DNA. Furthermore, T4 DNA polymerase was reacted for 5 minutes at 16° C. to perform a 5' terminal blunting reaction.

TABLE 3-1I1

Synthesis of complementary double stranded DNA

| Reagent | Content (μL) | Final concentration |
|---|---|---|
| Complementary DNA reaction solution | 9 | |
| Sterilized water | 46.5 | |
| 5x Second strand buffer | 15 | 25 mM Tris-HCl, pH 7.5, 100 mM KCl, 5 mM MgCl$_2$, 10 mM (NH$_4$)SO$_4$, 0.15 mM β-NAD+, 1.2 mM DTT |
| 10 mM dNTPs | 1.5 | 0.2 mM |
| *E. coli* DNA ligase, 10 U/μL (Invitrogen) | 0.5 | 0.067 U/μL |
| *E. coli* DNA polymerase, 10 U/μL (Invitrogen) | 2 | 0.27 U/μL |
| RNaseH, 2 U/μL (Invitrogen) | 0.5 | 0.013 U/μL |
| | Total 75 μL | 16° C., 2 hours |
| T4 DNA polymerase, 5 U/μL (Invitrogen) | 1 | 0.067 U/μL |
| | | 16° C., 5 minutes |

A double stranded DNA, after column purification by a High Pure PCR Cleanup Micro Kit (Roche), was incubated all night at 16° C. in the presence of a P20EA/10EA adaptor and T4 ligase in the following T4 ligase buffer for a ligation reaction.

TABLE 3-1J

Adaptor adding reaction

| Reagent | content (μL) | Final concentration |
|---|---|---|
| Complementary double stranded DNA solution | 12.5 | |
| T4 ligase buffer | 5 | 50 mM Tris-HCl, pH 7.6, 10 mM MgCl$_2$, 1 mM ATP, 5% PEG5000, 1 mM DTT |
| 50 μM P20EA/10EA adaptor | 5 | 10 μM |
| T4 DNA ligase, 1 U/μL (Invitrogen) | 2.5 | 0.1 U/μL |
| | Total 25 | 16° C., all night |

An adaptor added double stranded DNA purified by a column as discussed above was digested by a NotI restriction enzyme (50 U/μL, Takara) with the following composition in order to remove an adaptor added to the 3' terminal.

TABLE 3-1K1

Restriction enzyme treatment

| Reagent | Content (μL) | Final concentration |
|---|---|---|
| Complementary double stranded DNA solution | 34 | |
| 10x restriction enzyme buffer | 5 | 50 mM Tris-HCl, pH 7.5, 10 mM MgCl$_2$, 1 mM, 1 mM DTT, 100 mM NaCl |
| 0.1% BSA | 5 | 0.01% |
| 0.1% Triton X-100 | 5 | 0.01% |
| NotI, 50 U/μL (Takara) | 1 | 1 U/μL |
| | Total 50 | 37° C., 2 hours |

5. PCR

The $1^{st}$ PCR amplification was performed by using a common adaptor primer P20EA and a TCRα chain or β chain C region specific primer (CB1) from a double stranded complementary DNA from a double stranded complementary DNA. cycles of PCR were performed, where a cycle was 30 seconds at 95° C., 30 seconds at 55° C., and one minute at 72° C. with the composition shown below.

TABLE 3-1L $1^{st}$ PCR amplification reaction composition

| | Content (μL) | Final concentration |
|---|---|---|
| 2x ExTaq Premix (Takara) | 10 | 10 mM Tris-HCl (pH 8.3) 50 mM KCl 2 mM MgCl$_2$ 0.2 mM dNTPs 0.5 U ExTaq polymerase |
| 10 mM P20EA primer | 0.5 | 250 nM |
| 10 mM CB1 primer | 0.5 | 250 nM |
| Double stranded complementary DNA | 2 | |
| Sterilized water | 7 | |

A $1^{st}$ PCR amplicon was then used to perform nested PCR with the reaction composition shown below between a P20EA primer and each of the immunoglobulin isotype C region specific primers. 20 cycles of PCR were performed, where a cycle was 30 seconds at 95° C., 30 seconds at 55° C., and one minute at 72° C.

TABLE 3-1M $2^{nd}$ PCR amplification reaction composition

| | Content (μL) | Final concentration |
|---|---|---|
| 2x ExTaq Premix (Takara) | 10 | 10 mM Tris-HCl (pH 8.3) 50 mM KCl 2 mM MgCl$_2$ 0.2 mM dNTPs 0.5 U ExTaq polymerase |
| 10 mM P20EA primer | 1 | 500 nM |
| 10 mM CB2 primer | 1 | 500 nM |
| $1^{st}$ PCR amplicon | 2 | |
| Sterilized water | 6 | |

A primer was removed from the obtained $2^{nd}$ PCR amplicon by a High Pure PCR Cleanup Micro Kit (Roche). Furthermore, analysis was carried out with Roche's next generation sequence analyzer (GS Junior Bench Top system), with the $2^{nd}$ PCR amplicon diluted 10 fold as a template. Amplification utilized a B-P20EA primer, which is a P20EA adaptor primer added with an adaptor B sequence, and HuVaF- and HuVbF primers, which are TCRα chain and β chain C region specific primers added with an adaptor A sequence and each MID Tag sequence. 10 cycles of PCR were performed, where a cycle was 30 seconds at 95° C., 30 seconds at 55° C., and one minute at 72° C.

TABLE 3-1N

3rd PCR amplification reaction composition

| | Content (μL) | Final concentration |
|---|---|---|
| 2x ExTaq Premix (Takara) | 10 | 10 mM Tris-HCl (pH 8.3) 50 mM KCl 2 mM MgCl$_2$ 0.2 mM dNTPs 0.5 U ExTaq polymerase |
| 10 mM B-P20EA primer | 1 | 500 nM |
| Each of 10 mM HuVbF and HuVaF primers | 1 | 500 nM |
| 2nd PCR amplicon | 1 | |
| Sterilized water | 7 | |

6. Next Generation Sequencing

Next generation sequencing was carried out by Roche's GS Junior sequence analyzer. Specifically, a GS Junior Titanium emPCR Kit (Lib-L) was used to carry out emPCR in accordance with the protocol of the manufacturer at the ratio of beads to DNA (copy per beads: cpb) of 2. After emPCR, a sequence run was carried out for the beads collected with beads enrichment by using sequence run reagents GS Junior Titanium Sequencing Kit and PicoTiter-Plate Kit in accordance with the protocol of the manufacturer.

7. Data Analysis

The resulting sequence data (SFF file) was classified into read sequences for each MID Tag to create a sequence file in a Fasta format by a software that comes with GS Junior (sfffile or sffinfo). A repertoire analysis software (Repertoire Genesis) was used for collation with reference sequences in the IMGT database to assign an AV region, BV region, AJ region, and BJ region of each read and determine the CDR3 sequence.

8. Extraction of Overlapping Unique Reads in Analysis of 10 Healthy Individuals

As a normal control, TCR sequences of peripheral blood mononuclear cells of 10 healthy individuals were examined. An overlapping read was searched among individuals by using V, J and CDR3 sequences as an indicator for TCRα and TCRβ sequence reads obtained from each healthy individual. The number of overlapping unique reads and the number of individuals with such overlapping unique reads were examined between TCRα and TCRβ chains (Table 3-6). Relative to TCRβ chains, the number of overlapping unique reads was significantly more in TCRα chains (809 vs. 39) and the ratio thereof was also higher (2.37% vs. 0.19%). Further, there were overlapping reads in 8 out of 10 individuals at the maximum for TCRα chains, while all overlapping reads for TCR chains were overlapping in only 2 individuals. The results suggest that there is more similarity among individuals in a TCRα repertoire.

TABLE 3-6

Number of overlapping unique reads in healthy individuals

| Number of individuals (Total of 10 cases) | Number of overlapping unique reads | |
|---|---|---|
| | TCRα | TCRβ |
| 2 | 684 | 39 |
| 3 | 87 | 0 |
| 4 | 18 | 0 |
| 5 | 10 | 0 |
| 6 | 4 | 0 |
| 7 | 4 | 0 |
| 8 | 2 | 0 |
| 9 | 0 | 0 |
| 10 | 0 | 0 |
| Total overlapping reads (percentage) | 809 (2.37%) | 39 (0.19%) |

9. Analysis of Overlapping Reads in TCRα Chain

The base sequence of an overlapping read was examined in detail for a TCRα chain exhibiting a level of overlap among individuals that is high relative to a TCRβ chain. As a result, it was discovered that many of the TCR reads exhibiting a high level of overlap are TCRα genes derived from a mucosal-associated invariant T cell (MAIT) or a natural killer T cell (NKT) known as expressing an invariant chain (Table 3-7). NKT cells mainly express TRAV10 (Vα24)-TRAJ18 and MAITs mainly express a TCR consisting of TRAV1-2 (Vα7.2)-TRAJ33. It has been reported recently that a TCR of a MAIT recognizes a vitamin B metabolite of bacteria presented by an MR1 molecule and has drawn attention for the role in immunosurveillance function (Nature. 2012 Nov. 29; 491 (7426): 717-23; J Exp Med. 2013 Oct. 21; 210(11): 2305-20). When an overlapping read with a number of overlapping individuals of 4 or more was collated with an already reported invariant TCR, it was found that 45% thereof was accounted for by invariant TCRs (Table 3-7). In contrast to TCRα chains where there is a highly frequent overlapping read, the number of overlapping individuals for a TCR chain was at maximum 2 (Table 3-8). Thus, the high level of overlap in TCRα is estimated to be due to the presence of an invariant TCR. 21 types of TCRα reads, which could not be collated with an already reported invariant TCR, were identified among 38 types of highly frequently overlapping reads that overlap in 4 or more individuals (Table 3-9). The possibility is suggested or them being novel invariant TCRs.

TABLE 3-7

Overlapping TCRα chain read sequences in healthy individuals

| SEQ ID NO: | Number | n | TRAV | TRAJ | CDR3 | % Read (Mean) | Cell |
|---|---|---|---|---|---|---|---|
| 1550 | 1 | 8 | TRAV1-2 | TRAJ33 | CAVMDSNYQLIWG | 0.24 | MAIT |
| 1551 | 2 | 8 | TRAV1-2 | TRAJ20 | CAVRDGDYKLSFG | 0.08 | MAIT |

TABLE 3-7-continued

Overlapping TCRα chain read sequences in healthy individuals

| SEQ ID NO: | Number n | TRAV | TRAJ | CDR3 | % Read (Mean) | Cell |
|---|---|---|---|---|---|---|
| 1552 | 3 | 7 TRAV9-2 | TRAJ53 | CALSGGSNYKLTFG | 0.04 | |
| 1553 | 4 | 7 TRAV13-2 | TRAJ9 | CAENTGGFKTIFG | 0.03 | |
| 1554 | 5 | 7 TRAV1-2 | TRAJ33 | CAVRDSNYQLIWG | 0.23 | MAIT |
| 1555 | 6 | 7 TRAV1-2 | TRAJ12 | CAVMDSSYKLIFG | 0.12 | MAIT |
| 1556 | 7 | 6 TRAV1-2 | TRAJ33 | CAVTDSNYQLIWG | 0.05 | MAIT |
| 1557 | 8 | 6 TRAV1-2 | TRAJ33 | CAVLDSNYQLIWG | 0.11 | MAIT |
| 1558 | 9 | 6 TRAV1-2 | TRAJ20 | CAVRDRDYKLSFG | 0.06 | MAIT |
| 1559 | 10 | 6 TRAV10 | TRAJ18 | CVVSDRGSTLGRLYFG | 0.38 | NKT |
| 1560 | 11 | 5 TRAV9-2 | TRAJ23 | CALIYNQGGKLIFG | 0.02 | |
| 1561 | 12 | 5 TRAV9-2 | TRAJ20 | CALNDYKLSFG | 0.05 | |
| 1562 | 13 | 5 TRAV13-2 | TRAJ53 | CAENSGGSNYKLTFG | 0.04 | |
| 1563 | 14 | 5 TRAV13-2 | TRAJ39 | CAENNAGNMLTFG | 0.04 | |
| 1564 | 15 | 5 TRAV12-2 | TRAJ8 | CAVNTGFQKLVFG | 0.03 | |
| 1565 | 16 | 5 TRAV12-2 | TRAJ20 | CAVNDYKLSFG | 0.02 | |
| 1566 | 17 | 5 TRAV12-1 | TRAJ31 | CVVNNARLMFG | 0.02 | |
| 1567 | 18 | 5 TRAV1-2 | TRAJ33 | CAVKDSNYQLIWG | 0.13 | MAIT |
| 1568 | 19 | 5 TRAV1-2 | TRAJ33 | CAAMDSNYQLIWG | 0.08 | MAIT |
| 1569 | 20 | 5 TRAV1-2 | TRAJ33 | CAALDSNYQLIWG | 0.04 | MAIT |
| 1570 | 21 | 4 TRAV9-2 | TRAJ6 | CALSGGSYIPTFG | 0.06 | |
| 1571 | 22 | 4 TRAV9-2 | TRAJ42 | CALSDYGGSQGNLIFG | 0.05 | |
| 1572 | 23 | 4 TRAV9-2 | TRAJ35 | CALIGFGNVLHCG | 0.02 | |
| 1573 | 24 | 4 TRAV2 | TRAJ9 | CAVEEGTGGFKTIFG | 0.02 | |
| 1574 | 25 | 4 TRAV13-2 | TRAJ44 | CAENTGTASKLTFG | 0.02 | |
| 1575 | 26 | 4 TRAV13-1 | TRAJ53 | CAASGGSNYKLTFG | 0.03 | |
| 1576 | 27 | 4 TRAV12-2 | TRAJ6 | CAVSGGSYIPTFG | 0.04 | |
| 1577 | 28 | 4 TRAV12-2 | TRAJ30 | CAVNRDDKIIFG | 0.04 | |
| 1578 | 29 | 4 TRAV12-2 | TRAJ15 | CAVNQAGTALIFG | 0.05 | |
| 1579 | 30 | 4 TRAV12-2 | TRAJ15 | CAVNNQAGTALIFG | 0.02 | |
| 1580 | 31 | 4 TRAV12-1 | TRAJ49 | CVVNTGNQFYFG | 0.03 | |
| 1581 | 32 | 4 TRAV12-1 | TRAJ15 | CVVNQAGTALIFG | 0.12 | |
| 1582 | 33 | 4 TRAV1-2 | TRAJ33 | CAVVDSNYQLIWG | 0.05 | MAIT |
| 1583 | 34 | 4 TRAV1-2 | TRAJ33 | CAVSDSNYQLIWG | 0.07 | MAIT |
| 1584 | 35 | 4 TRAV1-2 | TRAJ33 | CASMDSNYQLIWG | 0.03 | MAIT |
| 1585 | 36 | 4 TRAV1-2 | TRAJ33 | CAPMDSNYQLIWG | 0.05 | MAIT |
| 1586 | 37 | 4 TRAV1-2 | TRAJ12 | CAVRDSSYKLIFG | 0.03 | MAIT |
| 1587 | 38 | 4 TRAV1-2 | TRAJ12 | CAVLDSSYKLIFG | 0.02 | MAIT |

MAIT: Mucosal-associated invariant T cells,
NKT: Natural killer T cells

TABLE 3-8

Overlapping TCRβ chain read sequences in healthy individuals

| SEQ ID NO: | Number | n | TRBV | TRBJ | CDR3 | % Read (Mean) |
|---|---|---|---|---|---|---|
| 1588 | 1 | 2 | TRBV9 | TRBJ2-5 | CASSVLRGGDPSTS | 0.051 |
| 1589 | 2 | 2 | TRBV9 | TRBJ2-5 | CASSGEVGRETQYFG | 0.051 |
| 1590 | 3 | 2 | TRBV9 | TRBJ2-2 | CASSYWGTGELFFG | 0.051 |
| 1591 | 4 | 2 | TRBV9 | TRBJ2-2 | CASSYWGPGSCFL | 0.051 |
| 1592 | 5 | 2 | TRBV9 | TRBJ1-5 | XASSVGTKDQPQHFG | 0.051 |
| 1593 | 6 | 2 | TRBV9 | TRBJ1-2 | CASXVATWTGTATPS | 0.051 |
| 1594 | 7 | 2 | TRBV9 | TRBJ1-2 | CASSVATLDRDGYTFG | 0.051 |
| 1595 | 8 | 2 | TRBV7-9 | TRBJ2-7 | CASTQSTGLRVLLR | 0.051 |
| 1596 | 9 | 2 | TRBV7-9 | TRBJ2-7 | CASSYRAATYEQYFG | 0.051 |
| 1597 | 10 | 2 | TRBV7-9 | TRBJ2-7 | CASSLGLAGARYEQYFG | 0.051 |
| 1598 | 11 | 2 | TRBV7-9 | TRBJ2-7 | CASSFRDSYEQYFG | 0.051 |
| 1599 | 12 | 2 | TRBV7-9 | TRBJ2-6 | CASTGAPGANVLTFG | 0.051 |
| 1600 | 13 | 2 | TRBV7-9 | TRBJ2-6 | CASSFPVPSGANVLTFG | 0.051 |
| 1601 | 14 | 2 | TRBV7-9 | TRBJ2-6 | CASRAEHGSRRRGQRPDFR | 0.051 |
| 1602 | 15 | 2 | TRBV7-9 | TRBJ2-5 | CASSLVGETQYFG | 0.029 |
| 1603 | 16 | 2 | TRBV7-9 | TRBJ2-1 | CASSLGTSGSRNEQFFG | 0.041 |
| 1604 | 17 | 2 | TRBV6-4 | TRBJ2-3 | CASSDSTTDTQYFG | 0.030 |
| 1605 | 18 | 2 | TRBV6-4 | TRBJ2-3 | CASSDGTGGTDTQYFG | 0.039 |
| 1606 | 19 | 2 | TRBV4-1 | TRBJ2-5 | CASSQGQGETQYFG | 0.057 |
| 1607 | 20 | 2 | TRBV29-1 | TRBJ2-7 | CSVGQGPNEQYFG | 0.044 |
| 1608 | 21 | 2 | TRBV29-1 | TRBJ2-7 | CSVAGTGAYEQYFG | 0.043 |
| 1609 | 22 | 2 | TRBV29-1 | TRBJ2-7 | CSVAASYEQYFG | 0.030 |
| 1610 | 23 | 2 | TRBV29-1 | TRBJ2-5 | CSVERETQYFG | 0.070 |
| 1611 | 24 | 2 | TRBV29-1 | TRBJ2-5 | CSVDSKETQYFG | 0.067 |
| 1612 | 25 | 2 | TRBV29-1 | TRBJ2-3 | CSVEGSTDTQYFG | 0.030 |
| 1613 | 26 | 2 | TRBV29-1 | TRBJ2-3 | CSVEEGTDTQYFG | 0.073 |
| 1614 | 27 | 2 | TRBV29-1 | TRBJ2-2 | CSVVGTGELFFG | 0.040 |
| 1615 | 28 | 2 | TRBV29-1 | TRBJ2-1 | CSVAGTSGYNEQFFG | 0.030 |
| 1616 | 29 | 2 | TRBV29-1 | TRBJ1-3 | CSVGTGNTIYFG | 0.058 |
| 1617 | 30 | 2 | TRBV29-1 | TRBJ1-2 | CSVRGGNYGYTFG | 0.041 |
| 1618 | 31 | 2 | TRBV29-1 | TRBJ1-2 | CSVGSGSYGYTFG | 0.042 |
| 1619 | 32 | 2 | TRBV28 | TRBJ2-7 | CASSPSYEQYFG | 0.030 |
| 1620 | 33 | 2 | TRBV28 | TRBJ2-5 | CASSLRGQETQYFG | 0.028 |
| 1621 | 34 | 2 | TRBV28 | TRBJ2-5 | CASSLRETQYFG | 0.045 |
| 1622 | 35 | 2 | TRBV28 | TRBJ2-2 | CASSLLTGELFFG | 0.029 |
| 1623 | 36 | 2 | TRBV20-1 | TRBJ2-7 | CSASGTSVSYEQYFG | 0.072 |
| 1624 | 37 | 2 | TRBV2 | TRBJ2-1 | CASSDNEQFFG | 0.038 |

TABLE 3-8-continued

Overlapping TCRβ chain read sequences in healthy individuals

| SEQ ID NO: | Number | n | TRBV | TRBJ | CDR3 | % Read (Mean) |
|---|---|---|---|---|---|---|
| 1625 | 38 | 2 | TRBV15 | TRBJ2-5 | CATSRDLGETQYFG | 0.044 |
| 1626 | 39 | 2 | TRBV12-3 | TRBJ1-1 | CASSLAGNTEAFFG | 0.059 |

TABLE 3-9

Invariant TCR candidate genes

| SEQ ID NO: | Number | TRAV | TRAJ | CDR3 |
|---|---|---|---|---|
| 1627 | 1 | TRAV9-2 | TRAJ53 | CALSGGSNYKLTFG |
| 1628 | 2 | TRAV13-2 | TRAJ9 | CAENTGGFKTIFG |
| 1629 | 3 | TRAV9-2 | TRAJ23 | CALIYNQGGKLIFG |
| 1630 | 4 | TRAV5-2 | TRAJ20 | CALNDYKLSFG |
| 1631 | 5 | TRAV13-2 | TRAJ53 | CAENSGGSNYKLTFG |
| 1632 | 6 | TRAV13-2 | TRAJ39 | CAENNAGNMLTFG |
| 1633 | 7 | TRAV12-2 | TRAJ8 | CAVNTGFQKLVFG |
| 1634 | 8 | TRAV12-2 | TRAJ20 | CAVNDYKLSFG |
| 1635 | 9 | TRAV12-1 | TRAJ31 | CVVNNARLMFG |
| 1636 | 10 | TRAV9-2 | TRAJ6 | CALSGGSYIPTFG |
| 1637 | 11 | TRAV9-2 | TRAJ42 | CALSDYGGSQGNLIFG |
| 1638 | 12 | TRAV9-2 | TRAJ35 | CALIGFGNVLHCG |
| 1639 | 13 | TRAV2 | TRAJ9 | CAVEEGTGGFKTIFG |
| 1640 | 14 | TRAV13-2 | TRAJ44 | CAENTGTASKLTFG |
| 1641 | 15 | TRAV13-1 | TRAJ53 | CAASGGSNYKLTFG |
| 1642 | 16 | TRAV12-2 | TRAJ6 | CAVSGGSYIPTFG |
| 1643 | 17 | TRAV12-2 | TRAJ30 | CAVNRDDKIIFG |
| 1644 | 18 | TRAV12-2 | TRAJ15 | CAVNQAGTALIFG |
| 1645 | 19 | TRAV12-2 | TRAJ15 | CAVNNQAGTALIFG |
| 1646 | 20 | TRAV12-1 | TRAJ49 | CVVNTGNQFYFG |
| 1647 | 21 | TRAV12-1 | TRAJ15 | CVVNQAGTALIFG |

10. Analysis of Overlapping Read in Colorectal Cancer Patient Tissue

It is known that a cancer antigen specific T cells is present in cancer tissue of a cancer patient and has an important role in an antitumor effect. In order to identify a cancer antigen specific TCR gene, a TCR repertoire is analyzed while targeting a patient with a specific HLA to identify a TCR gene that grows in response to a specific antigen. In this experiment, cancer tissue of 25 colorectal cancer patients having a common HLA-A2402 was used to carry out TCR repertoire analysis to search for a unique read that is present while overlapping among cancer patient samples (Table 3-10). As a result, it was found that 213 reads (1.65%) were present while overlapping in a plurality of patients for a TCRα chain and 49 reads (0.11%) for a TCR chain. As in healthy individuals, there is a highly frequently overlapping read in maximum of 12 out of 25 cases for a TCRα chain, while only a maximum of 2 for a TCRβ chain. For a TCRα chain, there is a common read among a maximum of 12 specimens, and sequences of 7 reads overlapping in cancer tissue of 4 or more specimens were TCRα chains having TRAV1-2/TRAJ33 derived from MAITs except for one case (Table 3-11). (Table 3-10 Number of cancer specific reads and number of overlapping unique reads in cancer tissue)

TABLE 3-10

| Number of individuals (total of 25 cases) | TCRα | | TCRβ | |
|---|---|---|---|---|
| | Number of overlapping reads | Number of cancer specific reads | Number of overlapping reads | Number of cancer specific reads |
| 2 | 192 | 150 | 47 | 46 |
| 3 | 14 | 7 | 2 | 2 |
| 4 | 2 | 0 | 0 | 0 |
| 5 | 1 | 0 | 0 | 0 |
| 6 | 2 | 0 | 0 | 0 |
| 7 | 0 | 0 | 0 | 0 |
| 8 | 0 | 0 | 0 | 0 |
| 9 | 0 | 0 | 0 | 0 |
| 10 | 1 | 0 | 0 | 0 |
| 11 | 0 | 0 | 0 | 0 |
| 12 | 1 | 0 | 0 | 0 |
| Total overlapping reads (percentage) | 213 (1.65%) | 157 (1.22%) | 49 (0.11%) | 48 (0.11%) |

TABLE 3-11

Overlapping TCRα read sequence and cancer specific TCRα read in cancer patient

| SEQ ID NO: | No. | TRAV | TRAJ | CDR3 | No. of cancer patients with overlap | No. of healthy individuals with overlap | % Read (Mean) | TCR types |
|---|---|---|---|---|---|---|---|---|
| 1648 | 1 | TRAV1-2 | TRAJ33 | CAVMDSNYQLIWG | 12 | 8 | 0.36 | MAIT (mucosal-associated invariant T) |
| 1649 | 2 | TRAV1-2 | TRAJ33 | CAVRDSNYQLIWG | 10 | 7 | 0.26 | MAIT |
| 1650 | 3 | TRAV1-2 | TRAJ33 | CAVLDSNYQLIWG | 6 | 6 | 0.38 | MAIT |
| 1651 | 4 | TRAV1-2 | TRAJ20 | CAVRDGDYKLSFG | 6 | 8 | 0.38 | MAIT |
| 1652 | 5 | TRAV13-1 | TRAJ16 | CAASKGGQKLLFA | 5 | 2 | 0.28 | Cancer specific |
| 1653 | 6 | TRAV1-2 | TRAJ33 | CAVKDSNYQLIWG | 4 | 5 | 0.11 | MAIT |
| 1654 | 7 | TRAV1-2 | TRAJ33 | CAAMDSNYQLIWG | 4 | 5 | 0.41 | MAIT |
| 1655 | 8 | TRAV9-2 | TRAJ57 | CALTQGGSEKLVFG | 3 | 0 | 0.40 | Cancer specific |
| 1656 | 9 | TRAV9-2 | TRAJ36 | CALSDQTGANNLFFG | 3 | 1 | 0.11 | Cancer specific |
| 1657 | 10 | TRAV9-2 | TRAJ34 | CALRKVRHRQAHLW | 3 | 0 | 0.39 | Cancer specific |
| 1658 | 11 | TRAV9-2 | TRAJ21 | CALRGYNFNKFYFG | 3 | 0 | 0.13 | Cancer specific |
| 1659 | 12 | TRAV9-2 | TRAJ20 | CALNDYKLSFG | 3 | 5 | 0.42 | Cancer specific |
| 1660 | 13 | TRAV4 | TRAJ5 | CLVGDRDTGRRALTFG | 3 | 0 | 0.20 | Cancer specific |
| 1661 | 14 | TRAV38-2 | TRAJ45 | CAYRSYSGGGADGLTFG | 3 | 0 | 0.42 | Cancer specific |
| 1662 | 15 | TRAV21 | TRAJ29 | CAVSGNTPLVFG | 3 | 1 | 0.36 | Cancer specific |
| 1663 | 16 | TRAV21 | TRAJ26 | CAVYGQNFVFG | 3 | 0 | 0.36 | Cancer specific |
| 1664 | 17 | TRAV13-2 | TRAJ22 | CAERVSSGSARQLTFG | 3 | 0 | 1.21 | Cancer specific |
| 1665 | 18 | TRAV12-3 | TRAJ11 | CAMNSGYSTLTFG | 3 | 1 | 0.12 | Cancer specific |
| 1666 | 19 | TRAV1-2 | TRAJ33 | CAALDSNYQLIWG | 3 | 5 | 0.08 | MAIT |
| 1667 | 20 | TRAV1-2 | TRAJ12 | GAVMDSSYKLIFG | 3 | 7 | 0.20 | MAIT |
| 1668 | 21 | TRAV10 | TRAJ18 | CVVSDRGSTLGRLYFG | 3 | 6 | 0.21 | NKT |
| 1669 | 22 | TRAV9-2 | TRAJ6 | CALSLSGGSYIPTFG | 2 | 1 | 0.13 | Cancer specific |
| 1670 | 23 | TRAV9-2 | TRAJ54 | CALSDRGAQKLVFG | 2 | 1 | 0.26 | Cancer specific |
| 1671 | 24 | TRAV9-2 | TRAJ54 | CALIIGREPRSWYL | 2 | 0 | 0.13 | Cancer specific |
| 1672 | 25 | TRAV9-2 | TRAJ54 | CALIIGEGAQKLVFG | 2 | 0 | 0.14 | Cancer specific |
| 1673 | 26 | TRAV9-2 | TRAJ53 | CALSGSGGSNYKLTFG | 2 | 3 | 0.56 | Cancer specific |
| 1674 | 27 | TRAV9-2 | TRAJ53 | CALSDLSGGSNYKLTFG | 2 | 0 | 0.04 | Cancer specific |
| 1675 | 28 | TRAV9-2 | TRAJ52 | CALRAGGTSYGKLTFG | 2 | 2 | 0.69 | Cancer specific |
| 1676 | 29 | TRAV9-2 | TRAJ5 | CALTLTMGRRALTFG | 2 | 0 | 0.11 | Cancer specific |
| 1677 | 30 | TRAV9-2 | TRAJ48 | CALDFGNEKLTFG | 2 | 0 | 0.09 | Cancer specific |
| 1678 | 31 | TRAV9-2 | TRAJ45 | CAPPPHGLTFG | 2 | 0 | 0.21 | Cancer specific |
| 1679 | 32 | TRAV9-2 | TRAJ45 | CALSYSGGGADGLTFG | 2 | 0 | 0.28 | Cancer specific |
| 1680 | 33 | TRAV9-2 | TRAJ45 | CALRGGGADGLTFG | 2 | 0 | 0.17 | Cancer specific |
| 1681 | 34 | TRAV9-2 | TRAJ44 | CALNTGTASKLTFG | 2 | 1 | 0.27 | Cancar specific |
| 1682 | 35 | TRAV9-2 | TRAJ43 | CALSDRNNDMRFG | 2 | 0 | 2.78 | Cancer specific |
| 1683 | 36 | TRAV9-2 | TRAJ39 | CALRAGNMLTFG | 2 | 0 | 0.08 | Cancer specific |

TABLE 3-11-continued

Overlapping TCRα read sequence and cancer specific TCRα read in cancer patient

| SEQ ID NO: | No. | TRAV | TRAJ | CDR3 | No. of cancer patients with overlap | No. of healthy individuals with overlap | % Read (Mean) | TCR types |
|---|---|---|---|---|---|---|---|---|
| 1684 | 37 | TRAV9-2 | TRAJ39 | CALLNNAGNMLTFG | 2 | 1 | 0.17 | Cancer specific |
| 1685 | 38 | TRAV9-2 | TRAJ37 | CALSSNTGKLIFG | 2 | 1 | 0.48 | Cancer specific |
| 1686 | 39 | TRAV9-2 | TRAJ34 | CALSDNTDKLIFG | 2 | 2 | 0.09 | Cancer specific |
| 1687 | 40 | TRAV9-2 | TRAJ34 | CALIDTDKLIFG | 2 | 0 | 0.09 | Cancer specific |
| 1688 | 41 | TRAV9-2 | TRAJ32 | CALSGGATNKLIFG | 2 | 1 | 0.17 | Cancer specific |
| 1689 | 42 | TRAV9-2 | TRAJ31 | CALTSNARLMFG | 2 | 0 | 0.61 | Cancer specific |
| 1690 | 43 | TRAV9-2 | TRAJ31 | CALNNNARLMFG | 2 | 1 | 0.07 | Cancer specific |
| 1691 | 44 | TRAV9-2 | TRAJ3 | CALSSYSSASKIIFG | 2 | 0 | 0.33 | Cancer specific |
| 1692 | 45 | TRAV9-2 | TRAJ3 | CALSHSSASKIIFG | 2 | 0 | 0.05 | Cancer specific |
| 1693 | 46 | TRAV9-2 | TRAJ3 | CALSDRRSSASKIIFG | 2 | 0 | 0.10 | Cancer specific |
| 1694 | 47 | TRAV9-2 | TRAJ3 | CALRDSSASKIIFG | 2 | 3 | 0.10 | Cancer specific |
| 1695 | 48 | TRAV9-2 | TRAJ20 | CALVSGNTPLVFG | 2 | 0 | 0.14 | Cancer specific |
| 1696 | 49 | TRAV9-2 | TRAJ29 | CALRGSGNTPLVFG | 2 | 0 | 0.09 | Cancer specific |
| 1697 | 50 | TRAV9-2 | TRAJ27 | CALSDRDTNAGKSTFG | 2 | 1 | 0.37 | Cancer specific |
| 1698 | 51 | TRAV9-2 | TRAJ27 | CALNTNAGKSTFG | 2 | 2 | 0.12 | Cancer specific |
| 1699 | 52 | TRAV9-2 | TRAJ23 | CALSFYNQGGKLIFG | 2 | 1 | 0.06 | Cancer specific |
| 1700 | 53 | TRAV9-2 | TRAJ23 | CALSDYNQGGKLIFG | 2 | 2 | 0.10 | Cancer specific |
| 1701 | 54 | TRAV9-2 | TRAJ23 | CALPIYNQGGKLIFG | 2 | 0 | 0.07 | Cancer specific |
| 1702 | 55 | TRAV9-2 | TRAJ22 | CALAGSARQLTFG | 2 | 0 | 0.05 | Cancer specific |
| 1703 | 56 | TRAV9-2 | TRAJ21 | CAPRYNFNKFYFG | 2 | 0 | 0.25 | Cancer specific |
| 1704 | 57 | TRAV9-2 | TRAJ20 | CALSQDDYKLSFG | 2 | 0 | 0.04 | Cancer specific |
| 1705 | 58 | TRAV9-2 | TRAJ17 | CALSDKAAGNKLTFG | 2 | 0 | 0.24 | Cancer specific |
| 1706 | 59 | TRAV9-2 | TRAJ17 | CALFKAAGNKLTFG | 2 | 0 | 0.50 | Cancer specific |
| 1707 | 60 | TRAV9-2 | TRAJ16 | CALSDRDGQKLLFA | 2 | 1 | 0.18 | Cancer specific |
| 1708 | 61 | TRAV9-2 | TRAJ15 | CALSGGAGTALIFG | 2 | 1 | 0.11 | Cancer specific |
| 1709 | 62 | TRAV9-2 | TRAJ15 | CALSAVEAGTALIFG | 2 | 0 | 0.82 | Cancer specific |
| 1710 | 63 | TRAV9-2 | TRAJ13 | CALTPSQQYQKVTFG | 2 | 0 | 0.08 | Cancer specific |
| 1711 | 64 | TRAV9-2 | TRAJ10 | CALGGAGGGNKLTFG | 2 | 0 | 0.24 | Cancer specific |
| 1712 | 65 | TRAV8-3 | TRAJ44 | CAVVIETTGTASKLTFG | 2 | 0 | 0.52 | Cancer specific |
| 1713 | 66 | TRAV8-3 | TRAJ43 | CAVGALNNNDMRFG | 2 | 3 | 0.47 | Cancer specific |
| 1714 | 67 | TRAV8-3 | TRAJ17 | CAVGAAGNKLTFG | 2 | 0 | 0.28 | Cancer specific |
| 1715 | 68 | TRAV8-2 | TRAJ4 | CVVSLSGGYNKLILE | 2 | 0 | 0.43 | Cancer specific |
| 1716 | 69 | TRAV8-1 | TRAJ27 | CAVQWWCYNKLIFG | 2 | 0 | 0.17 | Cancer specific |
| 1717 | 70 | TRAV6 | TRAJ6 | CALQSDGGSYIPTFG | 2 | 0 | 0.67 | Cancer specific |
| 1718 | 71 | TRAV6 | TRAJ37 | CALDISGNTGKLIFG | 2 | 0 | 0.08 | Cancer specific |
| 1719 | 72 | TRAV6 | TRAJ34 | CALGRFRQAHLW | 2 | 0 | 0.21 | Cancer specific |

TABLE 3-11-continued

Overlapping TCRα read sequence and cancer specific TCRα read in cancer patient

| SEQ ID NO: | No. | TRAV | TRAJ | CDR3 | No. of cancer patients with overlap | No. of healthy individuals with overlap | % Read (Mean) | TCR types |
|---|---|---|---|---|---|---|---|---|
| 1720 | 73 | TRAV5 | TRAJ5 | CAESRLTLYGHGQESTYFW | 2 | 0 | 0.10 | Cancer specific |
| 1721 | 74 | TRAV5 | TRAJ5 | CAERDTGRRALTFG | 2 | 0 | 0.45 | Cancer specific |
| 1722 | 75 | TRAV5 | TRAJ36 | CAESKRTGANNLFFG | 2 | 0 | 0.59 | Cancer specific |
| 1723 | 76 | TRAV4 | TRAJ9 | CLVGVEASKLSL | 2 | 0 | 0.05 | Cancer specific |
| 1724 | 77 | TRAV4 | TRAJ40 | CLVGTTSGTYKYIFG | 2 | 0 | 1.64 | Cancer specific |
| 1725 | 78 | TRAV4 | TRAJ37 | CLVGDTSNTGKLIFG | 2 | 0 | 0.14 | Cancer specific |
| 1726 | 79 | TRAV4 | TRAJ37 | CLDTSNTGKLIFG | 2 | 0 | 0.36 | Cancer specific |
| 1727 | 80 | TRAV4 | TRAJ22 | CLLTGSARQLTFG | 2 | 0 | 0.07 | Cancer specific |
| 1728 | 81 | TRAV38-2 | TRAJ32 | CAYRSGYGGATNKLIFG | 2 | 0 | 0.08 | Cancer specific |
| 1729 | 82 | TRAV38-2 | TRAJ31 | CAYRRRNNNARLMFG | 2 | 0 | 2.47 | Cancer specific |
| 1730 | 83 | TRAV38-1 | TRAJ33 | CAFMKHDWDSNYQLIWG | 2 | 0 | 0.25 | Cancer specific |
| 1731 | 84 | TRAV38-1 | TRAJ32 | CAFMTPGGATNKLIFG | 2 | 0 | 0.17 | Cancer specific |
| 1732 | 85 | TRAV36 | TRAJ54 | CAAIQGAQKLVFG | 2 | 0 | 0.32 | Cancer specific |
| 1733 | 86 | TRAV35 | TRAJ58 | CAGRPETSGSRLTFG | 2 | 0 | 0.11 | Cancer specific |
| 1734 | 87 | TRAV35 | TRAJ53 | CAGQGGGSNYKLTFG | 2 | 0 | 0.15 | Cancer specific |
| 1735 | 88 | TRAV35 | TRAJ28 | CAGQESGAGSYQLTFG | 2 | 0 | 0.07 | Cancer specific |
| 1736 | 89 | TRAV35 | TRAJ26 | CAGPDNYGQNFVFG | 2 | 0 | 0.18 | Cancer specific |
| 1737 | 90 | TRAV3 | TRAJ42 | CAVRDMRYGGSQGNLIFG | 2 | 0 | 0.22 | Cancer specific |
| 1738 | 91 | TRAV3 | TRAJ4 | CAVRDSGGYNKLYFW | 2 | 0 | 0.23 | Cancer specific |
| 1739 | 92 | TRAV3 | TRAJ4 | CAVRDSGGYNKLIFG | 2 | 0 | 1.27 | Cancer specific |
| 1740 | 93 | TRAV3 | TRAJ29 | CAVRAVNSGNTPLVFG | 2 | 0 | 0.09 | Cancer specific |
| 1741 | 94 | TRAV29 | TRAJ40 | CAASDSGTYKYIFG | 2 | 1 | 0.09 | Cancer specific |
| 1742 | 95 | TRAV29 | TRAJ29 | CAATEGNTPLVFG | 2 | 0 | 0.50 | Cancer specific |
| 1743 | 96 | TRAV26-2 | TRAJ7 | CTNPLGGNNRLAFG | 2 | 0 | 0.31 | Cancer specific |
| 1744 | 97 | TRAV26-2 | TRAJ44 | CILRDNTGTASKLTFG | 2 | 0 | 0.83 | Cancer specific |
| 1745 | 98 | TRAV26-2 | TRAJ35 | CILGGVWECAALR | 2 | 0 | 0.07 | Cancer specific |
| 1746 | 99 | TRAV26-2 | TRAJ35 | CILGGFGNVLHCG | 2 | 0 | 0.91 | Cancer specific |
| 1747 | 100 | TRAV26-2 | TRAJ32 | CILRVVLQTSSSL | 2 | 0 | 0.19 | Cancer specific |
| 1748 | 101 | TRAV26-2 | TRAJ23 | CILRDGHNQGGKLIFG | 2 | 0 | 0.15 | Cancer specific |
| 1749 | 102 | TRAV26-2 | TRAJ21 | CILMNNFNKFTLD | 2 | 0 | 0.14 | Cancer specific |
| 1750 | 103 | TRAV26-2 | TRAJ18 | CILTQRLNSGRLYFG | 2 | 0 | 0.17 | Cancer specific |
| 1751 | 104 | TRAV26-2 | TRAJ18 | CILTQRLNSGEAILW | 2 | 0 | 0.75 | Cancer specific |
| 1752 | 105 | TRAV26-1 | TRAJ57 | CIVRVAQGGSEKLVFG | 2 | 1 | 0.14 | Cancer specific |
| 1753 | 106 | TRAV26-1 | TRAJ52 | CIVRVSAGGTSYGKLTFG | 2 | 0 | 0.14 | Cancer specific |
| 1754 | 107 | TRAV26-1 | TRAJ5 | CIVTAYTGRRALTLG | 2 | 0 | 0.07 | Cancer specific |
| 1755 | 108 | TRAV26-1 | TRAJ5 | CIVTAYTGRRALTFG | 2 | 0 | 0.15 | Cancer specific |
| 1756 | 109 | TRAV26-1 | TRAJ49 | CIVRVPNTGNQFYFG | 2 | 0 | 0.52 | Cancer specific |

TABLE 3-11-continued

Overlapping TCRα read sequence and cancer specific TCRα read in cancer patient

| SEQ ID NO: | No. | TRAV | TRAJ | CDR3 | No. of cancer patients with overlap | No. of healthy individuals with overlap | % Read (Mean) | TCR types |
|---|---|---|---|---|---|---|---|---|
| 1757 | 110 | TRAV26-1 | TRAJ44 | CIVRADTGTASKLTFG | 2 | 0 | 0.21 | Cancer specific |
| 1758 | 111 | TRAV26-1 | TRAJ34 | CIVRVDNTDKLIFG | 2 | 1 | 0.88 | Cancer specific |
| 1759 | 112 | TRAV22 | TRAJ13 | CAGSLRGYQKVTFG | 2 | 0 | 0.23 | Cancer specific |
| 1760 | 113 | TRAV22 | TRAJ12 | CAGMDSSYKLIFG | 2 | 0 | 0.23 | Cancer specific |
| 1761 | 114 | TRAV21 | TRAJ9 | CAVGNTGGFKTIFG | 2 | 0 | 0.71 | Cancer specific |
| 1762 | 115 | TRAV21 | TRAJ6 | CAVKGGSYIPTFG | 2 | 0 | 0.08 | Cancer specific |
| 1763 | 116 | TRAV21 | TRAJ48 | CAVNHFGNEKLTFG | 2 | 0 | 0.62 | Cancer specific |
| 1764 | 117 | TRAV21 | TRAJ44 | CAVSTGTASKLTFG | 2 | 0 | 0.59 | Cancer specific |
| 1765 | 118 | TRAV21 | TRAJ44 | CAVRGTGTASKLTFG | 2 | 0 | 0.68 | Cancer specific |
| 1766 | 119 | TRAV21 | TRAJ41 | CAVARGSGYALNFG | 2 | 0 | 0.16 | Cancer specific |
| 1767 | 120 | TRAV21 | TRAJ29 | CAVNSGNTPLVFG | 2 | 0 | 0.26 | Cancer specific |
| 1768 | 121 | TRAV21 | TRAJ26 | CAVNYGQNFVFG | 2 | 0 | 0.44 | Cancer specific |
| 1769 | 122 | TRAV21 | TRAJ22 | CAVPFWFCKATDLW | 2 | 0 | 1.29 | Cancer specific |
| 1770 | 123 | TRAV21 | TRAJ10 | CAVGSGGGNKLTFG | 2 | 0 | 0.64 | Cancer specific |
| 1771 | 124 | TRAV20 | TRAJ57 | CAVQGGSEKLVFG | 2 | 1 | 0.54 | Cancer specific |
| 1772 | 125 | TRAV20 | TRAJ52 | CAVQVRGTSYGKLTFG | 2 | 0 | 0.43 | Cancer specific |
| 1773 | 126 | TRAV20 | TRAJ22 | CAVSGSARQLTFG | 2 | 0 | 1.05 | Cancer specific |
| 1774 | 127 | TRAV2 | TRAJ6 | CAVEGTGGSYIPTFG | 2 | 0 | 0.39 | Cancer specific |
| 1775 | 128 | TRAV2 | TRAJ5 | FPHGQESTYFW | 2 | 0 | 3.18 | Cancer specific |
| 1776 | 129 | TRAV2 | TRAJ5 | CAVDMDTGRRALTFG | 2 | 0 | 0.13 | Cancer specific |
| 1777 | 130 | TRAV2 | TRAJ44 | CAVGNTGTASKLTFG | 2 | 0 | 3.51 | Cancer specific |
| 1778 | 131 | TRAV2 | TRAJ43 | CAVEDNNDMRFG | 2 | 0 | 0.39 | Cancer specific |
| 1779 | 132 | TRAV2 | TRAJ42 | CAVDYGGSQGNLIFG | 2 | 1 | 0.08 | Cancer specific |
| 1780 | 133 | TRAV2 | TRAJ37 | CAVEWSSNTGKLIFG | 2 | 0 | 0.15 | Cancer specific |
| 1781 | 134 | TRAV2 | TRAJ34 | CAVPYNTDKLIFG | 2 | 0 | 0.36 | Cancer specific |
| 1782 | 135 | TRAV2 | TRAJ34 | CAVAVDKLIFG | 2 | 0 | 0.45 | Cancer specific |
| 1783 | 136 | TRAV2 | TRAJ33 | CAVKRGDSNYQLIWG | 2 | 0 | 0.24 | Cancer specific |
| 1784 | 137 | TRAV2 | TRAJ33 | CAVEDNYQLIWG | 2 | 0 | 0.13 | Cancer specific |
| 1785 | 138 | TRAV2 | TRAJ33 | CAVDSNYQLIWG | 2 | 0 | 0.31 | Cancer specific |
| 1786 | 139 | TRAV2 | TRAJ31 | CAVELNARLMFG | 2 | 0 | 3.40 | Cancer specific |
| 1787 | 140 | TRAV2 | TRAJ30 | CAVEDRRDDKIIFG | 2 | 0 | 0.11 | Cancer specific |
| 1788 | 141 | TRAV2 | TRAJ3 | CAVEDQNSSASKIIFG | 2 | 0 | 0.61 | Cancer specific |
| 1789 | 142 | TRAV2 | TRAJ3 | CAVALQQCFQDNLW | 2 | 0 | 0.97 | Cancer specific |
| 1790 | 143 | TRAV2 | TRAJ27 | CAANAGKSTFG | 2 | 0 | 0.71 | Cancer specific |
| 1791 | 144 | TRAV2 | TRAJ26 | CAVYNYGQNFVFG | 2 | 0 | 1.34 | Cancer specific |
| 1792 | 145 | TRAV2 | TRAJ26 | CAVEDRNYGQNFVFG | 2 | 1 | 0.22 | Cancer specific |

TABLE 3-11-continued

Overlapping TCRα read sequence and cancer specific TCRα read in cancer patient

| SEQ ID NO: | No. | TRAV | TRAJ | CDR3 | No. of cancer patients with overlap | No. of healthy individuals with overlap | % Read (Mean) | TCR types |
|---|---|---|---|---|---|---|---|---|
| 1793 | 146 | TRAV2 | TRAJ26 | CAVDNYGQNFVFG | 2 | 3 | 0.36 | Cancer specific |
| 1794 | 147 | TRAV2 | TRAJ26 | CAADNYGQNFVFG | 2 | 0 | 1.62 | Cancer specific |
| 1795 | 148 | TRAV2 | TRAJ22 | CAVESAARQLTFG | 2 | 0 | 3.72 | Cancer specific |
| 1796 | 149 | TRAV2 | TRAJ20 | CAVSSNDYKLSFG | 2 | 0 | 0.20 | Cancer specific |
| 1797 | 150 | TRAV2 | TRAJ15 | CAVPNQAGTALIFG | 2 | 0 | 0.12 | Cancer specific |
| 1798 | 151 | TRAV2 | TRAJ15 | CAVANQAGTALIFG | 2 | 1 | 0.52 | Cancer specific |
| 1799 | 152 | TRAV2 | TRAJ13 | CAVLNSGGYQKVTFG | 2 | 0 | 0.25 | Cancer specific |
| 1800 | 153 | TRAV19 | TRAJ41 | CALSEFSGYALNFG | 2 | 0 | 0.51 | Cancer specific |
| 1801 | 154 | TRAV17 | TRAJ30 | CATVSNRDDKIIFG | 2 | 0 | 0.19 | Cancer specific |
| 1802 | 155 | TRAV16 | TRAJ57 | CALATQGGSEKLVFG | 2 | 0 | 0.05 | Cancer specific |
| 1803 | 156 | TRAV16 | TRAJ47 | CALSLKYGNKLVFG | 2 | 0 | 1.34 | Cancer specific |
| 1804 | 157 | TRAV14 | TRAJ22 | CAMREPWNSGSARQLTFG | 2 | 0 | 0.09 | Cancer specific |
| 1805 | 158 | TRAV13-2 | TRAJ6 | CAENPTGGSYIPTFG | 2 | 0 | 0.69 | Cancer specific |
| 1806 | 159 | TRAV13-2 | TRAJ56 | CAESPTGANSKLTFG | 2 | 0 | 0.33 | Cancer specific |
| 1807 | 160 | TRAV13-2 | TRAJ45 | CAEPRRGGADGLTFG | 2 | 0 | 0.36 | Cancer specific |
| 1808 | 161 | TRAV13-2 | TRAJ39 | CAENNAGNMLTFG | 2 | 5 | 0.33 | Cancer specific |
| 1809 | 162 | TRAV13-2 | TRAJ34 | CAENIKNTDKLIFG | 2 | 0 | 0.28 | Cancer specific |
| 1810 | 163 | TRAV13-2 | TRAJ21 | CAERGGINKFYFG | 2 | 0 | 0.24 | Cancer specific |
| 1811 | 164 | TRAV13-2 | TRAJ15 | CAENQAGTALIFG | 2 | 3 | 0.34 | Cancer specific |
| 1812 | 165 | TRAV13-1 | TRAJ9 | CAASKGGFKTIFG | 2 | 0 | 0.18 | Cancer specific |
| 1813 | 166 | TRAV13-1 | TRAJ52 | CAAAGGTSYGKLTFG | 2 | 1 | 0.19 | Cancer specific |
| 1814 | 167 | TRAV13-1 | TRAJ5 | CAADTGRRALTFG | 2 | 0 | 0.18 | Cancer specific |
| 1815 | 168 | TRAV13-1 | TRAJ45 | CAASSYSGGGADGLTFG | 2 | 0 | 0.25 | Cancer specific |
| 1816 | 169 | TRAV13-1 | TRAJ45 | CAAPRVGGGADGLTFG | 2 | 0 | 1.38 | Cancer specific |
| 1817 | 170 | TRAV13-1 | TRAJ33 | CAASKRSNYQLIWG | 2 | 0 | 0.08 | Cancer specific |
| 1818 | 171 | TRAV13-1 | TRAJ33 | CAASKGSNYQLIWG | 2 | 1 | 0.04 | Cancer specific |
| 1819 | 172 | TRAV13-1 | TRAJ32 | CAASYGGATNKLIFG | 2 | 0 | 0.15 | Cancer specific |
| 1820 | 173 | TRAV13-1 | TRAJ3 | CAARGSSASKIIFG | 2 | 0 | 0.13 | Cancer specific |
| 1821 | 174 | TRAV13-1 | TRAJ27 | CAATYRNAGKSTFG | 2 | 0 | 0.26 | Cancer specific |
| 1822 | 175 | TRAV13-1 | TRAJ23 | CAASLYNQGGKLIFG | 2 | 1 | 0.53 | Cancer specific |
| 1823 | 176 | TRAV13-1 | TRAJ21 | CAASRGNFNKFYFG | 2 | 0 | 0.13 | Cancer specific |
| 1824 | 177 | TRAV13-1 | TRAJ20 | CAAQKGDYKLSFG | 2 | 0 | 0.08 | Cancer specific |
| 1825 | 178 | TRAV13-1 | TRAJ15 | CAASNQAGTALIFG | 2 | 3 | 0.53 | Cancar specific |
| 1826 | 179 | TRAV13-1 | TRAJ15 | CAANQAGTALIFG | 2 | 1 | 0.23 | Cancer specific |
| 1827 | 180 | TRAV13-1 | TRAJ10 | CAATREEETNSPL | 2 | 0 | 0.09 | Cancer specific |
| 1828 | 181 | TRAV12-3 | TRAJ37 | CAMSASSNTGKLIFG | 2 | 1 | 1.82 | Cancer specific |
| 1829 | 182 | TRAV12-3 | TRAJ31 | CAMNNNARLMFG | 2 | 0 | 0.18 | Cancer specific |

TABLE 3-11-continued

Overlapping TCRα read sequence and cancer specific TCRα read in cancer patient

| SEQ ID NO: | No. | TRAV | TRAJ | CDR3 | No. of cancer patients with overlap | No. of healthy individuals with overlap | % Read (Mean) | TCR types |
|---|---|---|---|---|---|---|---|---|
| 1830 | 183 | TRAV12-3 | TRAJ27 | CAMRGIRDAGKSTFG | 2 | 0 | 0.17 | Cancer specific |
| 1831 | 184 | TRAV12-3 | TRAJ23 | CAMSAYNQGGKLIFG | 2 | 0 | 0.38 | Cancer specific |
| 1832 | 185 | TRAV12-3 | TRAJ21 | CAMSEGRHNFNKFTLD | 2 | 0 | 0.19 | Cancer specific |
| 1333 | 186 | TRAV12-3 | TRAJ11 | CAMTGYSTLTFG | 2 | 0 | 0.08 | Cancer specific |
| 1834 | 187 | TRAV12-2 | TRAJ8 | CAVYRRKLHTYIW | 2 | 0 | 0.19 | Cancer specific |
| 1835 | 188 | TRAV12-2 | TRAJ3 | CAVYSSASKIIFG | 2 | 2 | 0.08 | Cancer specific |
| 1836 | 189 | TRAV12-1 | TRAJ9 | CGLNTGGFKTIFG | 2 | 0 | 0.80 | Cancer specific |
| 1837 | 190 | TRAV12-1 | TRAJ6 | CVVNEGGSYIPTFG | 2 | 1 | 0.99 | Cancer specific |
| 1838 | 191 | TRAV12-1 | TRAJ5 | CVVPLLMDTGRRALTFG | 2 | 0 | 0.13 | Cancer specific |
| 1839 | 192 | TRAV12-1 | TRAJ5 | CVVNMDTGRRALTFG | 2 | 0 | 0.14 | Cancer specific |
| 1840 | 193 | TRAV12-1 | TRAJ42 | CVLKPRGSQGNLIFG | 2 | 0 | 0.22 | Cancer specific |
| 1841 | 194 | TRAV12-1 | TRAJ36 | CVVNSPGANNLFFG | 2 | 0 | 0.10 | Cancer specific |
| 1842 | 195 | TRAV12-1 | TRAJ26 | CVVNDYGQNFVFG | 2 | 2 | 0.14 | Cancer specific |
| 1843 | 196 | TRAV12-1 | TRAJ20 | CAVNDYKLSFG | 2 | 1 | 0.36 | Cancer specific |
| 1844 | 197 | TRAV1-2 | TRAJ33 | CAVRDSSNYQLIWG | 2 | 0 | 0.07 | MAIT |
| 1845 | 198 | TRAV1-2 | TRAJ33 | CAVRDGNYQLIWG | 2 | 2 | 0.42 | MAIT |
| 1846 | 199 | TRAV1-2 | TRAJ33 | CAVMDSNYQLIWA | 2 | 3 | 0.06 | MAIT |
| 1847 | 200 | TRAV1-2 | TRAJ33 | CAVLDSNYQLIWA | 2 | 1 | 0.04 | MAIT |
| 1848 | 201 | TRAV1-2 | TRAJ33 | CATMDSNYQLIWG | 2 | 2 | 0.07 | MAIT |
| 1849 | 202 | TRAV1-2 | TRAJ32 | CAVRDHGGATNKLIFG | 2 | 0 | 0.49 | Cancer specific |
| 1850 | 203 | TRAV1-2 | TRAJ15 | CAVRGQAGTALIFG | 2 | 0 | 0.34 | Cancer specific |
| 1851 | 204 | TRAV1-2 | TRAJ12 | CASLDSSYKLIFG | 2 | 0 | 0.34 | MAIT |
| 1852 | 205 | TRAV1-1 | TRAJ33 | CAVRDSNYQLIWG | 2 | 0 | 0.26 | Cancer specific |
| 1853 | 206 | TRAV1-1 | TRAJ29 | CAVRDSRRGNTPLVFG | 2 | 0 | 0.13 | Cancer specific |
| 1854 | 207 | TRAV1-1 | TRAJ27 | CAVREPNTNAGKSTFG | 2 | 0 | 0.30 | Cancer specific |
| 1855 | 208 | TRAV1-1 | TRAJ17 | GAVKAAGNKLTFG | 2 | 0 | 0.11 | Cancer specific |
| 1856 | 209 | TRAV10 | TRAJ8 | CVVTLTMNTGFQKLVFG | 2 | 0 | 2.11 | Cancer specific |
| 1857 | 210 | TRAV10 | TRAJ40 | CVVPTSGTYKYIFG | 2 | 0 | 1.08 | Cancer specific |
| 1858 | 211 | TRAV10 | TRAJ4 | CVVTPSRAGGYNKLILE | 2 | 0 | 0.15 | Cancer specific |
| 1859 | 212 | TRAV10 | TRAJ4 | CVVSAESGGYNKLILE | 2 | 0 | 0.90 | Cancer specific |
| 1860 | 213 | TRAV10 | TRAJ4 | CVVSAESGGYNKLIFG | 2 | 0 | 1.70 | Cancer specific |

11. Extraction of Cancer Specific TCR Sequence

Figure 49:
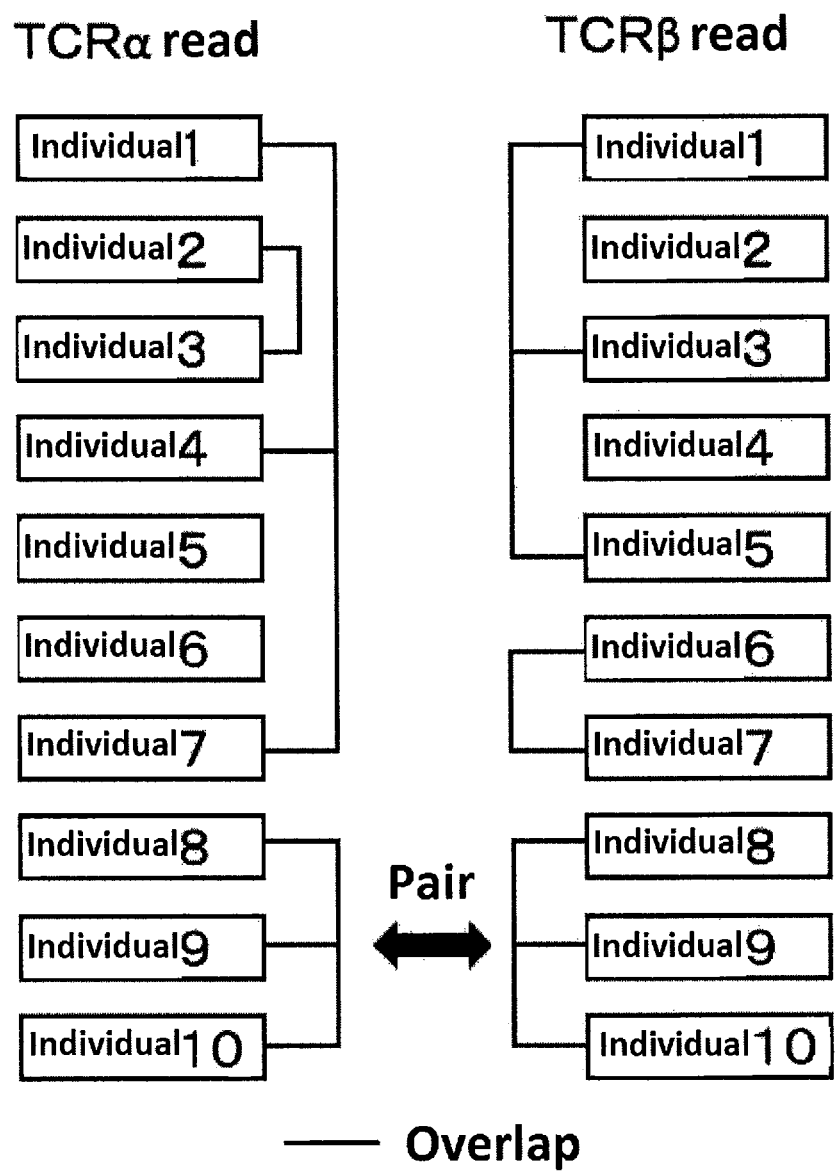
FIG. 49 is a schematic diagram of a method of estimating a TCRαβ pair read (see Example 3 of analysis system).

TCRα reads that overlap at a high frequency comprise many invariant TCRs. These sequences are also present in healthy individuals, who are normal controls, and are not TCRs that react to a tumor antigen. In order to extract a cancer specific TCR, overlapping reads in cancer tissue which are not detected in a sample of a healthy individual were classified as a cancer specific TCR (Table 3-12). There were 56 overlapping leads that are also present in healthy individuals in a TCRα chain, while there was only one such read in a TCRβ chain. Reads with a number of overlapping individuals of 4 or more were reads that were also present in a healthy individual or an invariant TCR. A cancer specific read overlapping in 3 or less individuals was detected in 157 reads (1.22%) in a TCRα chain and 48 reads (0.11%) in a TCRβ chain (also see FIG. 49 for method of estimating TCRαβ pair reads).

TABLE 3-12

Overlapping TCRβ read sequences and cancer specific TCRβ in cancer patient

| SEQ ID NO: | No. | TRBV | TRBJ | CDR3 | No. of cancer patients with overlap | No. of healthy individuals with overlap | % Read (mean) | TCR type |
|---|---|---|---|---|---|---|---|---|
| 1861 | 1 | TRBV20-1 | TRBJ2-1 | CSAREPGGGREQFFG | 3 | 0 | 0.43 | Cancer specific |
| 1862 | 2 | TRBV13 | TRBJ2-7 | CASSLAGGPYEQYFG | 3 | 0 | 1.98 | Cancer specific |
| 1863 | 3 | TRBV9 | TRBJ2-1 | CASSVDGDSYNEQFFG | 2 | 0 | 0.16 | Cancer specific |
| 1864 | 4 | TRBV7-9 | TRBJ2-3 | CASSSTDTQYFG | 2 | 0 | 0.20 | Cancer specific |
| 1865 | 5 | TRBV7-9 | TRBJ1-6 | CASSLSGDNSPLHFG | 2 | 0 | 0.04 | Cancer specific |
| 1866 | 6 | TRBV7-9 | TRBJ1-3 | CASSSGNTIYFG | 2 | 1 | 0.06 | |
| 1867 | 7 | TRBV7-8 | TRBJ2-2 | CASSPRGELFFG | 2 | 0 | 0.50 | Cancer specific |
| 1868 | 8 | TRBV7-8 | TRBJ1-3 | CASSRMGQGVGGNTIYFG | 2 | 0 | 0.10 | Cancer specific |
| 1869 | 9 | TRBV7-6 | TRBJ2-1 | CASSQRTSGITNEQFFG | 2 | 0 | 0.47 | Cancer specific |
| 1870 | 10 | TRBV7-3 | TRBJ2-2 | CASSLIGAGELFFW | 2 | 0 | 0.47 | Cancer specific |
| 1871 | 11 | TRBV6-6 | TRBJ2-3 | CASSTSSDTQYFW | 2 | 0 | 0.16 | Cancer specific |
| 1872 | 12 | TRBV6-6 | TRBJ1-1 | CASSYGMGVNTEAFFG | 2 | 0 | 0.33 | Cancer specific |
| 1873 | 13 | TRBV6-5 | TRBJ2-7 | CASSIQGYEQYFG | 2 | 0 | 0.19 | Cancer specific |
| 1874 | 14 | TRBV6-5 | TRBJ2-3 | CASGWASTDTQYFG | 2 | 0 | 0.21 | Cancer specific |
| 1875 | 15 | TRBV6-3 | TRBJ2-7 | CASSYGASSYEQYFG | 2 | 0 | 0.25 | Cancer specific |
| 1876 | 16 | TRBV6-3 | TRBJ2-5 | CASSYTAKKETQYFG | 2 | 0 | 0.40 | Cancer specific |
| 1877 | 17 | TRBV5-1 | TRBJ2-7 | CASSASLAGYEQYFG | 2 | 0 | 0.11 | Cancer specific |
| 1878 | 18 | TRBV4-3 | TRBJ2-1 | CASSHNTGTGNEQFFG | 2 | 0 | 1.75 | Cancer specific |
| 1879 | 19 | TRBV4-3 | TRBJ1-2 | CASSQDRSRVYGYTFG | 2 | 0 | 0.13 | Cancer specific |
| 1880 | 20 | TRBV4-2 | TRBJ1-2 | CASSQDVYGYTFG | 2 | 0 | 0.55 | Cancer specific |
| 1881 | 21 | TRBV4-1 | TRBJ2-7 | CASSQDLGVLRAVLR | 2 | 0 | 0.17 | Cancer specific |
| 1882 | 22 | TRBV4-1 | TRBJ2-1 | CASSLAQDYNEQFFG | 2 | 0 | 0.58 | Cancer specific |
| 1883 | 23 | TRBV4-1 | TRBJ1-5 | CASSQAPGQGAHFG | 2 | 0 | 0.14 | Cancer specific |
| 1884 | 24 | TRBV29-1 | TRBJ2-7 | CSVAAGVNYEQYFG | 2 | 0 | 2.39 | Cancer specific |
| 1885 | 25 | TRBV29-1 | TRBJ2-1 | CSVRPGTSGRGNEQFFG | 2 | 0 | 0.16 | Cancer specific |
| 1886 | 26 | TRBV29-1 | TRBJ2-1 | CSVLREITYNEQFFG | 2 | 0 | 0.18 | Cancer specific |
| 1887 | 27 | TRBV29-1 | TRBJ2-1 | CSVEPGAREQFFG | 2 | 0 | 0.44 | Cancer specific |
| 1888 | 28 | TRBV29-1 | TRBJ2-1 | CSVDLYNEQFFG | 2 | 0 | 4.36 | Cancer specific |
| 1889 | 29 | TR8V29-1 | TRBJ2-1 | CSAMLTGGGNEQFFG | 2 | 0 | 1.83 | Cancer specific |
| 1890 | 30 | TRBV25-1 | TRBJ2-5 | CASGQETQYFG | 2 | 0 | 0.34 | Cancer specific |

TABLE 3-12-continued

Overlapping TCRβ read sequences and cancer specific TCRβ in cancer patient

| SEQ ID NO: | No. | TRBV | TRBJ | CDR3 | No. of cancer patients with overlap | No. of healthy individuals with overlap | % Read (mean) | TCR type |
|---|---|---|---|---|---|---|---|---|
| 1891 | 31 | TRBV24/OR9-2 | TRBJ2-1 | CATSDLSGGSRSSYNEQFFG | 2 | 0 | 0.25 | Cancer specific |
| 1892 | 32 | TRBV20-1 | TRBJ2-7 | CSAPGGNLRAVLR | 2 | 0 | 0.47 | Cancer specific |
| 1893 | 33 | TRBV20-1 | TRBJ2-6 | CSAWDFTNSGANVLTFG | 2 | 0 | 0.14 | Cancer specific |
| 1894 | 34 | TRBV20-1 | TRBJ2-5 | CSARGRWAETQYFG | 2 | 0 | 0.18 | Cancer specific |
| 1895 | 35 | TRBV20-1 | TRBJ2-5 | CSAKQASETQYFG | 2 | 0 | 0.09 | Cancer specific |
| 1896 | 36 | TRBV20/OR9-2 | TRBJ2-4 | CSARDWRGAKNIQYFG | 2 | 0 | 0.08 | Cancer specific |
| 1897 | 37 | TRBV19 | TRBJ2-1 | CASSMIREYNEQFFG | 2 | 0 | 0.39 | Cancer specific |
| 1898 | 38 | TRBV19 | TRBJ2-1 | CASSITSASYEQFFG | 2 | 0 | 0.08 | Cancer specific |
| 1899 | 39 | TRBV19 | TRBJ1-5 | CASSILGNGNQPQHFG | 2 | 0 | 0.37 | Cancer specific |
| 1900 | 40 | TRBV19 | TRBJ1-2 | CASSIERGIYGYTFG | 2 | 0 | 0.32 | Cancer specific |
| 1901 | 41 | TRBV18 | TRBJ2-7 | CASSPLNEYEQYFG | 2 | 0 | 0.05 | Cancer specific |
| 1902 | 42 | TRBV12-4 | TRBJ2-7 | CASSMGTGTYEQYFG | 2 | 0 | 0.68 | Cancer specific |
| 1903 | 43 | TRBV12-4 | TRBJ1-1 | CASSFSAPKPTPLSL | 2 | 0 | 0.08 | Cancer specific |
| 1904 | 44 | TRBV12-3 | TRBJ1-1 | CASSLRANTEAFFG | 2 | 0 | 0.80 | Cancer specific |
| 1905 | 45 | TRBV11-2 | TRBJ2-3 | CASSSAGDTQYFW | 2 | 0 | 0.30 | Cancer specific |
| 1906 | 46 | TRBV11-1 | TRBJ2-7 | CASSRRQGAYEQYFG | 2 | 0 | 0.33 | Cancer specific |
| 1907 | 47 | TRBV11-1 | TRBJ1-2 | CASSLPGYGYTFG | 2 | 0 | 0.21 | Cancer specific |
| 1908 | 48 | TRBV10-3 | TRBJ2-3 | CAISERRIAGTSTDTQYFG | 2 | 0 | 0.69 | Cancer specific |
| 1909 | 49 | TRBV10-3 | TRBJ1-2 | CAISEFAGPEGYTFG | 2 | 0 | 0.19 | Cancer specific |

TABLE 3-13

Estimation of paired TCRαβ by combination of overlapping individuals

| TCRβ.read number | TCRα.read number |
|---|---|
| 1 | |
| 2 | |
| 3 | 205 |
| 4 | 49 |
| 5 | 176 |
| 6 | 121 |
| 7 | |
| 8 | |
| 9 | 64 |
| 10 | 144 |
| 11 | |
| 12 | 54 |
| 13 | 54 |
| 14 | 24, 25, 111, 162, 210 |
| 15 | 76 |
| 16 | 112, 139 |
| 17 | |
| 18 | 43 |
| 19 | 30 |
| 20 | 89, 133 |
| 21 | 72, 82, 84, 95, 100, 129, 168, 179, 183, 186, 191 |
| 22 | |
| 23 | 96, 159 |
| 24 | 112, 139 |
| 25 | |
| 26 | |
| 27 | 96, 159 |
| 28 | 43 |
| 29 | |
| 30 | |
| 31 | 42, 62 |
| 32 | |
| 33 | 75, 119, 157 |
| 34 | 54, 208 |
| 35 | |
| 36 | 77 |
| 37 | |
| 38 | 46, 102, 125, 155, 204 |
| 39 | |
| 40 | |
| 41 | |
| 42 | 189 |
| 43 | |
| 44 | 158 |

TABLE 3-13-continued

Estimation of paired TCRαβ by combination of overlapping individuals

| TCRβ.read number | TCRα.read number |
|---|---|
| 45 | 144 |
| 46 | |
| 47 | |
| 48 | 112, 139 |
| 49 | 96, 159 |

Example 3 of Analysis System

Sequencing Using Ion PGM System (Ion Torrent)

(1. RNA Extraction)

5 mL of whole blood was collected from a healthy individual in a heparin-containing blood collection tube. Peripheral blood mononuclear cells (PBMC) were separated by ficoll density gradient centrifugation. Total RNA was extracted/purified from the isolated PBMCs by using an RNeasy Lipid Tissue Mini Kit (Qiagen, Germany). The resulting RNA was quantified by using an Agilent 2100 bioanalyzer (Agilent).

(2. Synthesis of Complementary DNA and Double Stranded Complementary DNA)

The extracted RNA sample was used to carry out an adaptor-ligation PCR. The method was carried out in accordance with the method shown in Example 1. Specifically, a BSL-18E primer (Table 3-14) and RNA were admixed and annealed, and then a reverse transcriptase was used to synthesize a complementary strand DNA. A double-stranded DNA was subsequently synthesized. Furthermore, T4 DNA polymerase was used to perform a 5' terminal blunting reaction. After column purification by a High Pure PCR Cleanup Micro Kit (Roche), a P20EA/P10EA adaptor was added in a ligation reaction. An adaptor added double stranded complementary DNA purified by a column was digested by a NotI restriction enzyme.

TABLE 3-14

Primer sequences

| Primer | Sequence |
|---|---|
| BSL-18E | AAAGCGGCCGCATTTTTTTTTTTTTTTTVN (SEQ ID NO: 32) |
| P20EA | TAATACGACTCCGAATTCCC (SEQ ID NO: 33) |
| P10EA | GGGAATTCGG (SEQ ID NO: 34) |
| CA1 | TGTTGAAGGCGTTTGCACATGCA (SEQ ID NO: 35) |
| CA2 | GTGCATAGACCTCATGTCTAGCA (SEQ ID NO: 36) |
| CB1 | GAACTGGACTTGACAGCGGAACT (SEQ ID NO: 37) |
| CB2 | AGGCAGTATCTGGAGTCATTGAG (SEQ ID NO: 38) |

(3. PCR)

The $1^{st}$ PCR amplification was performed for a first PCR amplification reaction product from a double stranded complementary DNA by using a common adaptor primer P20EA and a TCRα chain or β chain C region specific primer (CA1 or CB1) shown in Table 3-14. 20 cycles of PCR were performed, where a cycle was 30 seconds at 95° C., 30 seconds at 55° C., and one minute at 72° C. with the following reaction composition.

TABLE 3-15A $1^{st}$ PCR amplification reaction composition

| | Content (µL) | Final concentration |
|---|---|---|
| 2x ExTaq Premix (Takara) | 10 | 10 mM Tris-HCl (pH 8.3) |
| | | 50 mM KCl |
| | | 2 mM MgCl$_2$ |
| | | 0.2 mM dNTPs |
| | | 0.5 U ExTaq polymerase |
| 10 mM P20EA primer | 0.5 | 250 nM |
| 10 mM CA1 or CB1 primer | 0.5 | 250 nM |
| Double stranded complementary DNA | 2 | |
| Sterilized water | 7 | |

A $1^{st}$ PCR amplicon was then used to perform $2^{nd}$ PCR with the reaction composition shown below by using a P20EA primer and a TCRα chain or β chain C region specific primer (CA2 or CB2). 20 cycles of PCR were performed, where a cycle was 30 seconds at 95° C., 30 seconds at 55° C., and one minute at 72° C.

TABLE 3-15B $2^{nd}$ PCR amplification reaction composition

| | Content (µL) | Final concentration |
|---|---|---|
| 2x ExTaq Premix (Takara) | 10 | 10 mM Tris-HCl (pH 8.3) |
| | | 50 mM KCl |
| | | 2 mM MgCl$_2$ |
| | | 0.2 mM dNTPs |
| | | 0.5 U ExTaq polymerase |
| 10 mM P20EA primer | 1 | 500 nM |
| 10 mM CA2 or CB2 primer | 1 | 500 nM |
| $1^{st}$ PCR amplicon | 2 | |
| Sterilized water | 6 | |

PCR was performed with the $2^{nd}$ PCR amplicon diluted 10 fold as a template by utilizing a B-P20EA primer shown in FIG. 10, which is a P20EA adaptor primer added with an adaptor B sequence, and HuVaF-01-HuVaF10 (α chain) and HuVbF-01-HuVbF-10 (β chain), which are a TCRα chain or β chain C region specific primer added with an adaptor A sequence and each MID Tag sequence (MID-1 to 26). The primer sequences used are shown in Table 6. 10 cycles of PCR were performed, where a cycle was 30 seconds at 95° C., 30 seconds at 55° C., and one minute at 72° C. To confirm PCR amplification, 10 µL of amplicon was amplified with 2% agarose gel electrophoresis.

TABLE 3-16

Sequencing primers

| Primer | Sequence | MID tag |
|---|---|---|
| HuVaF-03 | CCATCTCATCCCTGCCTGTCTCCGACTCAGACGAGTGCGTATAGGCACACACACTTGTCACTG (SEQ ID NO: 40) | MID-1 |
| HuVaF-03 | CCATCTCATCCCTGCGTGTCTCCGACTCAGACGCTCGACAATAGGCAGACAGACTTGTCACTG (SEQ ID NO: 41) | MID-2 |
| HuVaF-03 | CCATCTCATCCCTGCGTGTCTCCGACTCAGAGACQCACTCATAQGCAGACAGACTTGTCACTG (SEQ ID NO: 42) | MID-3 |
| HuVaF-04 | CCATCTCATCCCTGCGTGTCTCCGACTCAGAGCACTGTAGATAGGCAGACAGACTTGTCACTG (SEQ ID NO: 43) | MID-4 |
| HuVaF-05 | CCATCTCATCCCTGCGTGTCTCCGACTGAGATCAGACACGATAGGCAGAGAGACTTGTCAGTG (SEQ ID NO: 44) | MID-5 |
| HuVaF-06 | CCATCTCATCCCTGCGTGTGTCCGACTCAGATATCGGGAAATAGGCADACAGACTTGTCAGTG (SEQ ID NO: 45) | MID-6 |
| HuVaF-07 | CCATCTCATCCCTGCGTGTCTCCGACTCAGCGTGTCTGTAATAGGGAGACAGACTTGTCACTG (SEQ ID NO: 46) | MID-7 |
| HuVaF-08 | CCATCTCATCCCTGCGTGTCTCCGACTCAGCTCGCGTGTCATAGGCAGACAGACTTGTCACTG (SEQ ID NO: 47) | MID-8 |
| HuVaF-09 | CCATCTCATCCCTGCGTGTCTCCGACTCAGTCTCTATGCGATAGCCAGACAGACTTGTCACTG (SEQ ID NO: 48) | MID-10 |
| HuVaF-10 | CCATCTCATCCCTGCGTGTCTCCGACTCAGTGATACGTCTATAGGCAGACAGACTTGTCACTG (SEQ ID NO: 49) | MID-14 |
| HuVbF-01 | CCATCTCATCCCTGCGTGTCTCCGACTCAGATACGACGTAACACCAGTGTGGCCTTTTGGGTG (SEQ ID NO: 50) | MID-15 |
| HuVbF-02 | CCATGTCATCCCTGCGTGTCTCCGACTCAGTCACGTACTAACACCAGTGTGGCCTTTTGGGTG (SEQ ID NO: 51) | MID-16 |
| HuVbF-03 | CCATCTCATCCCTGCGTGTCTCCGACTCAGCGTCTAGTACACACCAGTGTGGCCTTTTGGGTG (SEQ ID NO: 52) | MID-17 |
| HuVbF-04 | CCATCTCATCCCTGCGTGTCTCCGACTCAGTCTACGTAGCACACCAGTGTGCCCTTTTGGGTG (SEQ ID NO: 53) | MID-18 |
| HuVbF-05 | CCATGTCATCCCTGCGTGTCTCCGACTCAGTGTACTACTCACACCAGTGTGGCCTTTTGGGTG (SEQ ID NO: 54) | MID-19 |
| HuVbF-06 | CCATCTCATCCCTGCGTGTCTCCGACTCAGACGACTACAGACACCAGTGTGGCCTTTTGGGTG (SEQ ID NO: 55) | MID-20 |
| HuVbF-07 | CCATCTCATCCCTGCGTGTGTCCGACTCAGCGTAGACTAGACACCAGTGTGGCCTTTTGGGTG (SEQ ID NO: 56) | MID-21 |
| HuVbF-08 | CCATCTCATCCCTCCGTGTCTCCGACTCAGTACCAGTATGACACCAGTGTGGCCTTTTGGGTG (SEQ ID NO: 57) | MID-22 |
| HuVbF-09 | CCATGTCATCCCTGCGTGTCTCCGACTCAGTACTCTCGTGACACCAGTGTGGCCTTTTGGGTG (SEQ ID NO: 58) | MID-23 |
| HuVbF-10 | CCATCTCATCCCTGCGTGTCTCCGACTCAGTAGAGACGAGACACCAGTGTGGCCTTTTGGGTG (SEQ ID NO: 59) | MID-24 |
| B-P20EA | CCTATCCCCTGTGTGCCTTGGCAGTCTAATACGACTCCGAATTCCC (SEQ ID NO: 60) | — |

TABLE 3-15C

3rd PCR amplification reaction composition

| | Content (μL) | Final concentration |
|---|---|---|
| 2x ExTaq Premix (Takara) | 10 | 10 mM Tris-HCl (pH 8.3) |
| | | 50 mM KCl |
| | | 2 mM MgCl$_2$ |
| | | 0.2 mM dNTPs |
| | | 0.5 U ExTaq polymerase |
| 10 mM B-P20EA primer | 1 | 500 nM |
| 10 mM HuVaF or (オ HuVbF) primer | 1 | 500 nM |
| 2nd PCR amplicon | 1 | |
| Sterilized water | 7 | |

An Ion OneTouch 2 system (Ion Torrent) was then used to perform emulsion PCR and adjust a template. An Ion OneTouch 2 (Ion Torrent) kit was used to mix the following solution.

TABLE 3-17

| Solution 1 | |
|---|---|
| Sterilized water | 25 μL |
| Ion PGM Template OT2 200 Reagent Mix | 500 μL |
| Ion PGM Template OT2 200 Reagent B | 300 μL |
| Ion PGM Template OT2 200 Enzyme Mix | 50 μL |
| Diluted library | 25 μL |
| Total amount | 900 μL |

An Ion Sphere Particle (ISP) bead was stirred and then 100 μL of ISP was added and mixed as described below.

TABLE 3-18

| Solution 1 | 900 μL |
|---|---|
| Ion PGM Template OT2 200 Ion Sphere Particle | 100 μL |
| Total amount | 1000 μL |

The above-described 1,000 μL is sufficiently mixed and then stirred for 5 minutes. After setting up an Ion OneTouch Plus Reaction Filter Assembly, the total amount described above is loaded. Furthermore, 500 μL of Ion OneTouch Reaction Oil is added and then a run is initiated. After about 5.5 hours of reaction, a sample is collected. After centrifugation to remove an excessive solution, ISP is collected.

Enrichment

An Ion OneTouch ES (Ion Torrent) is used to enrich a sample. A new tube is set in a chip loader, and a chip arm is installed. The following melt-off solution is then prepared.

Melt-Off Solution

TABLE 3-19

| | |
|---|---|
| Tween Solution | 280 µL |
| 1M sodium hydroxide | 40 µL |
| Total amount | 320 µL |

Dispensing the following solution to each well of 8 strip tubes

TABLE 3-20

| Well | | |
|---|---|---|
| 1 | ISP sample | 100 µL |
| 2 | Dynabeads MyOne Beads | 130 µL |
| 3 | Ion OneTouch Wash Solution | 300 µL |
| 4 | Ion OneTouch Wash Solution | 300 µL |
| 5 | Ion OneTouch Wash Solution | 300 µL |
| 6 | Empty | — |
| 7 | Melt-Off solution | 300 µL |
| 8 | Empty | — |

After setting up a reagent, an apparatus for Ion OneTouch ES is initiated for enrichment. After completion, tubes containing ISP are collected and gently inverted and mixed 5 times. An Ion PGM Sequencing 200 Kit v2 (Ion Torrent) is then used for sequencing.

It can be understood that the system of the present invention can use an apparatus other than Roche apparatuses in this manner.

Example 4 of Analysis System

TCR Sequencing Using Illumina MiSeq System

The present Example demonstrates whether the system of the present invention can be implemented in TCR sequencing using an Illumina MiSeq system.

(1. RNA Extraction)

5 mL of whole blood was collected from a healthy individual in a heparin-containing blood collection tube. Peripheral blood mononuclear cells (PBMC) were separated by ficoll density gradient centrifugation. Total RNA was extracted/purified from the isolated PBMCs by using an RNeasy Lipid Tissue Mini Kit (Qiagen, Germany). The resulting RNA was quantified by using an Agilent 2100 bioanalyzer (Agilent).

(2. Synthesis of Complementary DNA and Double Stranded Complementary DNA)

The extracted RNA sample was used to carry out an adaptor-ligation PCR. The method was carried out in accordance with the method shown in Example 1. Specifically, a BSL-18E primer (Table 3-21) and RNA were admixed and annealed, and then a reverse transcriptase was used to synthesize a complementary strand DNA. A double-stranded complementary DNA was subsequently synthesized, and T4 DNA polymerase was used to perform a 5' terminal blunting reaction. After column purification by a High Pure PCR Cleanup Micro Kit (Roche), a P20EA/P10EA adaptor was added in a ligation reaction. An adaptor added double stranded complementary DNA purified by a column was digested by a NotI restriction enzyme.

TABLE 3-21

Primer sequences

| Primer | Sequence |
|---|---|
| BSL-18E | AAAGCGGCCGCATGCTTTTTTTTTTTTTTTTTVN (SEQ ID NO: 32) |
| P20EA | TAATACGACTCCGAATTCCC (SEQ ID NO: 33) |
| P10EA | GGGAATTCGG (SEQ ID NO: 34) |
| CA1 | TGTTGAAGGCGTTTGCACATGCA (SEQ ID NO: 35) |
| CA2 | GTGCATAGACCTCATGTCTAGCA (SEQ ID NO: 36) |
| CB1 | GAACTGGACTTGACAGCGGAACT (SEQ ID NO: 37) |
| CB2 | AGGCAGTATCTGGAGTCATTGAG (SEQ ID NO: 38) |

(3. PCR)

The $1^{st}$ PCR amplification was performed for a first PCR amplification reaction product from a double stranded complementary DNA by using a common adaptor primer P20EA shown in Table 1 and a TCRα chain or β chain C region specific primer (CA1 or CB1). 20 cycles of PCR were performed, where a cycle was 30 seconds at 95° C., 30 seconds at 55° C., and one minute at 72° C. with the reaction composition in the following Table 3-22.

TABLE 3-22

1st PCR amplification reaction composition

| | Content (µL) | Final concentration |
|---|---|---|
| 2x ExTaq Premix (Takara) | 10 | 10 mM Tris-HCl (pH 8.3)<br>50 mM KCl<br>2 mM MgCl$_2$<br>0.2 mM dNTPs<br>0.5 U ExTaq polymerase |
| 10 mM P20EA primer | 0.5 | 250 nM |
| 10 mM CA1 or CB1 primer | 0.5 | 250 nM |
| Double stranded complementary DNA | 2 | |
| Sterilized water | 7 | |

A $1^{st}$ PCR amplicon was then used to perform $2^{nd}$ PCR with the reaction composition shown in the following Table 3-23 bp using a P20EA primer and a TCRα chain or β chain C region specific primer (CA2 or CB2). 20 cycles of PCR were performed, where a cycle was 30 seconds at 95° C., 30 seconds at 55° C., and one minute at 72° C.

TABLE 3-23

$2^{nd}$ PCR amplification reaction composition

| | Content (µL) | Final concentration |
|---|---|---|
| 2x ExTaq Premix (Takara) | 10 | 10 mM Tris-HCl (pH 8.3)<br>50 mM KCl<br>2 mM MgCl$_2$<br>0.2 mM dNTPs<br>0.5 U ExTaq polymerase |
| 10 mM P20EA primer | 1 | 500 nM |
| 10 mM CA2 or CB2 primer | 1 | 500 nM |
| $1^{st}$ PCR amplicon | 2 | |
| Sterilized water | 6 | |

(4. MiSeq Dual-Indexed Paired-End Sequencing)

Figure 50:
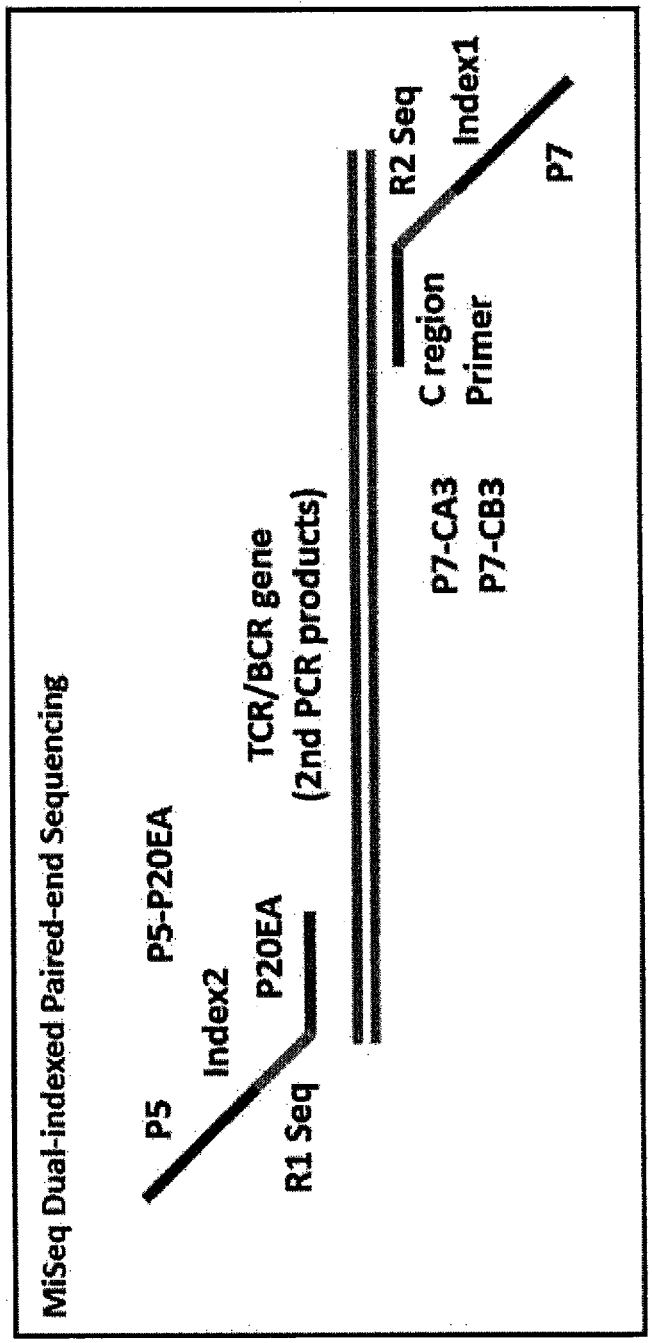
FIG. 50 shows a schematic diagram of MiSeq Dual-indexed Paired-end Sequencing in Example 4 of the analysis system.

A PCR amplification reaction is performed with the $2^{nd}$ PCR amplicon diluted 10 fold as a template by utilizing a P5-P20EA primer, which is a P20EA adaptor primer added with a P5 sequence, R1 Seq Primer sequence, and Index2 sequence, and P7-CA3 or P7-CB3, which is a TCRα chain or β chain C region specific primer added with a P7 sequence, R2 Seq Primer sequence and Index1 sequence as shown in FIG. 50. Different Index1 and Index2 sequences are used to label an amplification primer to identify an amplified TCR gene amplicon from a plurality of samples. The primer sequences used are shown in Table 3-24. 10 cycles of PCR were performed, where a cycle was 30 seconds at 95° C., 30 seconds at 55° C., and one minute at 72° C.

TABLE 3-24

| \multicolumn{2}{c}{Sequencing primers} | |
| --- | --- |
| Primer | Sequence |
| P5-P20EA | AATGATACGGCGACACCGAGATCTACAC (Index 2)-TCTTTCGCTACACGACGCTCTTCCGATCT-TAATACGACTCCG AATTCCC ((1)~(12) correspond to SEQ ID NOs: 1910~1921, respectively) |
| P7-CA3 | CAAGCAGAAGACGGCATACGAGAT-(Index 1)-GTGACTGGAGTTCAGACGTGTGCTCTTCCGATCT-ATAGGC AGACAGACTTGTCACTG ((1)~(8) correspond to SEQ ID NOs: 1922~1929, respectively) |
| P7-CB3 | CAAGCAGAAGACGGCATACGAGAT-(Index 1)-GTGACTGGAGTTCAGACGTGTGCTCTTCCGATCT-ACACCA GTGTGGCCTTTTGGGTG ((1)~(8) 配列それぞれ配列番号 1930~1937 に対応 ) |
| Index 1(1) | TGAACCTT |
| (2) | TGCTAAGT |
| (3) | TGTTCTCT |
| (4) | TAAGACAC |
| (5) | CTAATCGA |
| (6) | CTAGAACA |
| (7) | TAAGTTCC |
| (8) | TAGACCTA |
| Index 2(1) | ATCACGAC |
| (2) | ACAGTGGT |
| (3) | CAGATCCA |
| (4) | ACAAACGG |
| (5) | ACCCAGCA |
| (6) | AACCCCTC |
| (7) | CCCAACCT |
| (8) | CACCACAC |
| (9) | GAAACCCA |
| (10) | TGTGACCA |
| (11) | AGGGTCAA |
| (12) | AGGAGTGG |

TABLE 3-25

3rd PCR amplification reaction composition

| | Content (μL) | Final concentration |
|---|---|---|
| 2x ExTaq Premix (Takara) | 10 | 10 mM Tris-HCl (pH 8.3) |
| | | 50 mM KCl |
| | | 2 mM MgCl$_2$ |
| | | 0.2 mM dNTPs |
| | | 0.5 U ExTaq polymerase |
| 10 mM P5-P20EA primer | 1 | 500 nM |
| 10 mM P7-CA3 or P7-CB3) primer | 1 | 500 nM |
| 2$^{nd}$ PCR amplicon | 1 | |
| Sterilized water | 7 | |

(5. Purification of PCR Product by Electrophoresis)

An E-Gel agarose gel electrophoresis system is used for electrophoresis of an amplified PCR product. A precast gel containing a highly sensitive fluorescent staining agent is set in an electrophoresis apparatus, and 20 μL of sample per well is added to 2% agarose gel for electrophoresis. The amplicon is collected when a band of interest corresponding to 500-600 bp is eluted. The amount of DNA is measured by using a Quant-T™ PicoGreen® dsDNA Assay Kit (Invitrogen) for the collected PCR amplicon. Based on the resulting amount of DNA, a plurality of samples of equal molecular weight are mixed to perform a sequencing reaction.

(6. MiSeq Sequencing)

A MiSeq sample sheet is created. PhiX control is added in the range of 5-50% and sequencing is started with an MiSEQ sequencer in which a MiSeq Reagent Kit v. 3 (600 cycle, Illumina) is installed. After about 65 hours, sequencing data can be obtained.

Example 5 of Analysis System

High Throughput Sequence Analysis Method for Determining Diversity and Similarity of TCRα and TCRβ Repertoires to Determine a Potentially Novel Invariant TCRα Chain—Invariant TCR Expressed by NKT Cells and MAIT Cells as Example A comprehensive example is described below as an example summarizing the technologies described in Examples 1-4 of analysis system.

(Introduction)

As discussed above, high throughput sequencing techniques known as next generation sequencing (NGS) have undergone rapid advances, enabling large-scale sequence data analysis (Shendure J et al. (2008) Nat Biotechnol 26: 1135-1145; Metzker M L et al. (2010) Nat Rev Genet11: 31-46). Several TCR repertoire analysis systems based on NGS have been developed by other researchers. However, many of the amplification techniques are based on Multiple PCR comprising a different specific primer in each variable region. For this reason, bias during PCR amplification cannot be avoided as bias is very common due to differential hybridization dynamics among variable region specific primers for different target genes. Thus, when using a Multiple PCR assay, a correction and an additional computational standardizing method are considered necessary in order to minimize PCR bias (Carlson C S et al. (2013) Nat Commun 4: 2680). Use of a single set of primers is a preferred method for accomplishing unbiased quantitative amplification of all TCR genes including unknown mutants with a highly diverse 5' terminal of a sequence. Single strand oligonucleotide anchor ligation to the 3' terminal of a cDNA including T4 RNA ligase (Troutt A B et al. (1992) Proc Natl Acad Sci USA 89: 9823-9825), cDNA homopolymer tailing, 5' rapid amplification of cDNA ends (RACE) (Frohman M A et al. (1988) Proc Natl Acad Sci USA 85: 8998-9002), and template switching PCR (TS-PCR or SMART PCR) (Zhu Y Y et al. (2001) Biotechniques 30: 892-897) have been used to analyze TCR repertoires (Freeman J D et al. (2009) Genome Res 19: 1817-1824; Warren R L et al. (2011) Genome Res 21: 790-797). TS-PCR is simple and convenient, but a TS primer is either non-specifically annealed to a random region of RNA or repeated added. Thus, a high level of background amplification occurs (Alon S et al. (2011) Genome Res 21: 1506-1511; Kapteyn J (2010) BMC Genomics 11: 413). In this regard, present specification describes an adaptor-ligation mediated PCR (first reported by Tsuruta et al (Tsuruta Y et al. (1993) J Immunol Methods 161: 7-21; Tsuruta Y et al. (1994) J Immunol Methods 169: 17-23)) developed by an addition of an adaptor to the 5' terminal of a double stranded complementary DNA derived from a subsequent PCR amplicon by a constant region specific primer, adaptor primer, and TCR transcript. Adaptor-ligation to a blunted double stranded complementary DNA is barely affected by the specific sequence of a cDNA, while the efficiency of 5' adaptor-ligation using a T4 RNA ligase is sequence dependent (Jayaprakash A D et al. (2011) Nucleic Acids Res 39: e141). Furthermore, ligation of double stranded DNAs using a T4 ligase is more efficient than ssDNA ligation using a T4 RNA ligase in ligation anchored PCR (LA-PCR). Thus, such an unbiased AL-PCR allows accurate analysis of a TCR repertoire without requiring correction or standardization.

Various sequencing techniques have been developed such as Roche 454 (San Francisco, Calif.), Illumina (San Diego, Calif.), Ion-Torrent (Life Technologies, Grand Island, N.Y.), SOLID (Life Technologies), Helicos (Cambridge, Mass.) and PacBio (Menlo Park, Calif.). Among these NGS platforms, 454 DNA sequencing creates sequence reads in the range of 50-600 base pairs (bp) or more and sufficient read output, but the number of reads per one sequencing is less than Illumina. Long read sequencing enables determination of the full length or mostly full-length of a TCR gene comprising V, D, J, and C regions. Furthermore, a recombinant TCR protein is readily generated by subsequent PCR cloning of a TCR gene. Thus, the inventors applied the adaptor-ligation mediated PCR to NGS using 454 DNA sequencing.

Natural killer T (NKT) cell are a population of separate T cells having an important role in natural immunity and acquired immunity. NKT cells regulate a wide range of immune responses such as autoimmune diseases, tumor surveillance, and host defense against a pathogenic infection. NKT cells express invariant TCRα consisting of Vα24 and Jα18 recognizing glycolipids presented by CD1d and nonclassical major histocompatibility complex class I associated protein (Godfrey D I et al. (2004) J Clin Invest 114: 1379-1388). Recently, mucosal-associated invariant T (MAIT) cells preferentially present in mucous membrane tissue have been shown to be the only T cell population expressing semi-invariant TCRα consisting of Vα7.2 and Jα33. MAIT cells recognize a microorganism vitamin B metabolite presented by MHC associated protein 1 (MR1) and nonclassical MHC class I molecules (Kjer-Nielsen L et al. (2012) Nature 491: 717-723). These T cell populations having invariant TCRα serve a central role in immunomodulation. However, it is still unidentified whether all invariant TCRα is expressed by the only T cell populations.

In the present study, the inventors used TCR repertoire analysis based on NGS that has been newly developed to perform NGS sequencing of a TCR transcript from 20 healthy individuals. First, use of a variable region and joining region was tested based on the number of sequence reads, and then clonality and diversity in TCRα and TCRβ genes were analyzed. Unique read sequences identified by using an independently developed gene analysis program were compared at the clone level among healthy individuals. The results showed diversity in T cells to a similar extent and similar use of TRV and TRJ among individuals. Interestingly, a TCRβ read was not shared among individuals, while a TCRα read contained a public sequence overlapping in 2 or more individuals at a high frequency. A public TCRα read contained a high percentage of invariant TCRα, indicating the presence of iNKT or MAIT cells.

In the present Example, the inventors show from NGS data that analysis of a TCR gene shared among a plurality of individuals can provide significant information in invariant TCRs expressed by NKT cells and MAIT cells.

(Demonstration in the Present Example)

High throughput sequencing of T cell receptor (TCR) genes can be a potent tool for analyzing clonality and diversity of T lymphocytes and antigen specificity. In this regard, the inventors have developed a novel TCR repertoire analysis method using 454 DNA sequencing technique combined with adaptor-ligation mediated polymerase chain reaction (PCR). This method enables amplification of all TCR genes in a truly unbiased manner, contrary to a level of pseudo-bias that can be accomplished with SMART PCR, without any bias that generally occurs in PCR.

In the present Example, the inventors have performed next generation sequencing (NGS) on TCRα and TCRβ genes in peripheral blood mononuclear cells from 20 health individuals to compare diversity and similarity of expressed TCR repertoires and use of genes among individuals. 149, 216 unique reads were identified from a total of 267,037 sequence reads from the 20 healthy individuals. Preferential use of some V genes and J genes was observed, while some recombination in TRAV and TRAJ appeared to be limited. The level of observed TCR diversity differed significantly between TCRα and TCRβ, while a TCRα repertoire was more similar among individuals than a TCRβ repertoire. The similarity among individuals of TCRα was greatly dependent on the presence of a public TCR shared among 2 or more individuals at a high frequency. Publicly available TCRα has a TCR near a germ line having a shorter CDR3. A public TCRα sequence, especially a sequence shared among many individuals, often contained invariant TCRα derived from a mucosal-associated invariant T cell and an invariant natural killer T cell. The results suggest that search for a public TCR by NGS is useful in identifying a potentially novel invariant TCRα chain. This NGS method was found to be capable of highly precise comprehensive analysis of a TCR repertoire at a clone level.

(Materials and Methods)

Isolation of RNA Extract and Peripheral Blood Mononuclear Cells

Whole blood was collected form 20 healthy individuals after obtaining informed consent. The present study was approved by the ethics committee of Clinical Research Center for Allergy and Rheumatology, National Hospital Organization, Sagamihara National Hospital. 10 mL of whole blood was collected in a heparin treated tube. Peripheral blood mononuclear cells (PBMC) were separated by Ficoll-Paque PLUS™ (GE Healthcare Health Sciences, Uppsala, Sweden) density gradient centrifugation, and washed with phosphate buffered saline (PBS). The number of cells was counted and $1 \times 10^6$ cells were used in RNA extraction. Total RNA was isolated and purified by using an RNeasy Lipid Tissue Mini Kit (Qiagen, Hilden, Germany) in accordance with the manufacture's manual. The amount of RNA and purity were measured by using an Agilent 2100 bioanalyzer (Agilent Technologies, Palo Alto, Calif.).

Unbiased Amplification of TCR Gene

1 μg of total RNA was converted to a complementary DNA (cDNA) by using a Superscript III reverse transcriptase (Invitrogen, Carlsbad, Calif.). A BSL-18E primer comprising $poly_{18}$ and NotI site was used for cDNA synthesis. After cDNA synthesis, a double strand (ds)-cDNA was synthesized by using *E. Coli* DNA polymerase I (Invitrogen), *E. coli* DNA ligase (Invitrogen), and RNase H (Invitrogen). A ds-cDNA was blunted by using T4 DNA polymerase (Invitrogen). A P10EA/P20EA adaptor was linked to the 5' terminal of the ds-cDNA and then cleaved with a NotI restriction enzyme. After removing the adaptor and primer by using a MinElute Reaction Cleanup kit (Qiagen), PCR was performed by using either a TCRα chain constant region specific primer (CA1) or TCRβ chain constant region specific primer (CB1) and P20EA (Table 4-1). The PCR conditions were as follows: 20 cycles of 95° C. (30 seconds), 55° C. (30 seconds), and 72° C. (one minute). A $2^{nd}$ PCR was performed by using the same PCR conditions with either CA2 or CB2 and a P20EA primer.

TABLE 4-1

Primers used in the present Example

| Primer | Sequence | MID Tag |
|---|---|---|
| BSL-18E | AAAGCGGCCGCATGCTTTTTTTTTTTTTTTTTT VN (SEQ ID NO: 32) | |
| P20EA | TAATACGACTCCGAATTCCC (SEQ ID NO: 33) | |
| P10EA | GGGAATTCGG (SEQ ID NO: 34) | |
| CA1 | TGTTGAAGGCGTTTGCACATGCA (SEQ ID NO: 35) | |
| CA2 | GTGCATAGACCTCATGTCTAGCA (SEQ ID NO: 36) | |
| CB1 | GAACTGGACTTGACAGCGGAACT (SEQ ID NO: 37) | |

TABLE 4-1-continued

Primers used in the present Example

| Primer | Sequence | MID Tag |
|---|---|---|
| CB2 | AGGCAGTATCTGGAGTCATTGAG (SEQ ID NO: 38) | |
| HuVaF-01-10 | CCATCTCATCCCTGCGTGTCTCCGAC<u>TCAG</u>-{MID}-ATAGGCAGACAGACTTGTCACTG (SEQ ID NO: 40~49) | MID1-MID11 |
| HuVbF-01-10 | CCATCTCATCCCTGCGTGTCTCCGAC<u>TCAG</u>-{MID}-ACACCAGTGTGGCCTTTTGGGTG (SEQ ID NO: 50~59) | MID15-MID24 |
| B-P20EA | *CCTATCCCCTGTGTGCCTTGGCAGT*TAATACGACTCCGAATTCCC (SEQ ID NO: 60) | |

V: A/C/G, N: A/C/G/T, Adaptors A and B are described in bold and bold Italic, respectfully.
The key sequence (TCAG) is underlined.
The following MID Tag sequences were used for identifying a sample.
MID1 (SEQ ID NO: 1325),
MID2 (SEQ ID NO: 1326),
MID3 (SEQ ID NO: 1327),
MID4 (SEQ ID NO: 1328),
MID5 (SEQ ID NO: 1329),
MID6 (SEQ ID NO: 1330),
MID7 (SEQ ID NO: 1331),
MID8 (SEQ ID NO: 1332),
MID10 (SEQ ID NO: 1334),
MID11 (SEQ ID NO: 1335),
MID15 (SEQ ID NO: 1339),
MID16 (SEQ ID NO: 1340),
MID17 (SEQ ID NO: 1341),
MID18 (SEQ ID NO: 1342),
MID19 (SEQ ID NO: 1343),
MID20 (SEQ ID NO: 1344),
MID21 (SEQ ID NO: 1345),
MID22 (SEQ ID NO: 1346),
MID23 (SEQ ID NO: 1347),
MID24 (SEQ ID NO: 1348)

Sequencing of amplicon by Roche 454 sequencing system

An amplicon for NGS was prepared by amplification of a $2^{nd}$ PCR product using a P20EA primer and a fusion tag primer (Table 4-1). A fusion tag primer comprising an adaptor A sequence (CCATCTCATCCCTGCGTGTCTCCGAC) (SEQ ID NO: 39), key of 4 base sequences (TCAG), molecule identification (MID) tag sequence (10 nucleotides), and TCR constant region specific sequence were designed in accordance with the manufacturer's manual. After PCR amplification, an amplicon was separated and assessed by agarose gel electrophoresis. A resulting fragment (about 600 bp) was removed from the gel and purified by using a QIAEX II gel extraction kit (Qiagen). The amount of purified amplicon was quantified by a Quant-iT™ PicoGreen® dsDNA Assay Kit (Life Technologies, Carlsbad, Calif.). Each amplicon obtained by using a different fusion tag primer from 10 healthy individuals was mixed at equimolar concentration. Emulsion PCR (emPCR) was performed in accordance with the manufacturer's manual by using an amplicon mixture with a GS Junior Titanium emPCR Lib-L kit (Roche 454 Life Sciences, Branford, Conn.).

Assignment of TRV and TRJ Segments

All read sequences were classified with a MID Tag sequence. Artificially added sequences (tag, adaptor, and key) and sequences with a low quality score were removed from both ends of the read sequences by using a software installed on the 454 sequencing system. The remaining sequences were used in assignment of TRAV and TRAJ for a TCR.alpha. sequence and assignment of TRBV and TRBJ for a TCR.beta. sequence. The sequences were assigned by sequencing using the highest identity in a data set of reference sequences for 54 TRAV, 61 TRAJ, 65 TRBV and 14 TRBJ genes including pseudogenes and a data set of Open Reading Frame (ORF) reference sequences available from ImMunoGeneTics information System® (IMGT) database (http colon+//www dot-imgt dot-org). Data processing, assignment, and data accumulation were automatically performed by using a repertoire analysis software (Repertoire Genesis, RG) developed independently by the inventors. RG executed BLATN, automatic accumulation program, graphic program for use of TRV and TRJ, and program for sequence homology search using a CDR3 chain length distribution. Sequence homology between a query sequence and entry sequence at a nucleotide level was automatically calculated. Parameters that increased sensitivity and precision (E value threshold, minimum kernel, high score segment pair (HSP) score) were carefully optimized for each repertoire analysis.

Data Analysis

A nucleotide sequence of CDR3 in the range from the conserved cysteine at position 104 (Cys 104) (named by IMGT) to conserved phenylalanine at position 118 (Phe118) and the subsequent glycine (Gly119) were translated into an estimated amino acid sequence. A unique sequence read (USR) was defined as a sequence read without identity in an estimated amino acid sequence of CDR3 comprising TRV, TRJ and other sequence reads. The number of copies of the same USR was automatically counted by the RG software in each sample, and ranking was then assigned in the order of number of copies. The percentage of frequency of appearance of sequence reads comprising TRAV, TRAJ, TRBV and TRBJ genes in all sequence reads was calculated.

Search for USR Shared Among Samples

In order to search for a sequence shared among samples, a character string of "TRV gene name"_"estimated amino acid sequence of CDR3 region"_"TRJ gene name" (e.g., TRBV1_CASTRVVJFG_TRBJ2-5) of a USR of an individual was used as a TCR identifier. A TCR identifier in a sample was searched in a read data set from all other samples.

Diversity Index and Similarity Index

In order to estimate TCR diversity in a deep sequence data, several diversity indices, Simpson's indices and Shannon-Weaver's indices were calculated by using the function "diversity" of a vegan package in the R program. The indices were calculated based on the number of types per sample and number of individuals per sample as the scale of ecological biological diversity. USR and the number of copies were used for types and individuals, respectively, in the deep sequence data. The Simpson's index $(1-\lambda)$ was defined as the following:

$$1 - \lambda = 1 - \sum_{i=1}^{S}\left(\frac{n_i(n_i-1)}{N(N-1)}\right) \quad \text{[Numeral 4-1]}$$

(wherein N is the total number of sequence reads, $n_i$ is the number of copies of the ith USR, and S is the number of types of USR). The value ranges from 0-1, where the maximum number 1 means a high level of diversity and 0 means low diversity. The inverse Simpson's index $(1/\lambda)$ was also calculated as the inverse of $\lambda$. The Shannon-Weaver's index (H') was used as a diversity index and defined as follows:

$$H' = -\sum_{i=1}^{S}\frac{n_i}{N}\ln\frac{n_i}{N} \quad \text{[Numeral 4-2]}$$

(wherein N is the total number of sequence reads, $n_i$ is the number of copies of the ith USR, and S is the number of types of USR). These diversity indices should be biased due to the difference in the number of reads among samples. Thus, the number of sequence reads was standardized for each sample to the minimum number of sequence reads (Venturi V et al. (2007) J Immunol Methods 321: 182-195). To standardize the sample size, random sampling was repeated 1000 times without replacement to calculate a diversity index by using an R program. The median value of the indices was used to determine the diversity index for a sample.

To estimate similarity of TCR repertoires among healthy individuals, a Morisita-Horn index $(C_H)$ was defined as follows:

$$C_H = \frac{2\sum_{i=1}^{S} x_i y_i}{\left(\frac{\sum_{i=1}^{S} x_i^2}{X^2} + \frac{\sum_{i=1}^{S} y_i^2}{Y^2}\right)XY} \quad \text{[Numeral 4-3]}$$

(wherein $x_i$ is the number of the ith USR in all X reads of a single sample, $y_i$ is the number of the ith USR in all Y reads in another sample, S is the number of USRs). To standardize the sample size, random sampling was repeated 1000 times without replacement to calculate a similarity index by using an R program (Venturi V et al. (2008) J Immunol Methods 329: 67-80). The median value was used for a similarity index between a pair of samples.

Statistics

Statistical significance was tested by a nonparametric Mann-Whitney U test by using the GraphPad Prism software (version 4.0, San Diego, Calif.). A value of $p<0.05$ is considered statistically significant.

(Results)

Repertoire Analysis Software

The cloud-based software platform RG that was developed in the present study is a high-speed, accurate and convenient computational system for TCR repertoire analysis. RG provides a consolidated software package for (1) assignment of V, D, and J segments, (2) calculation of sequence identity, (3) extraction of a CDR3 sequence, (4) counting of identical reads, (5) amino acid translation, (6) frame analysis (stop and frame shift), and (7) analysis of CDR3 length. After uploading sequencing data from an NGS sequencer, V, D, and J segments can be identified based on sequence similarity thereof by using optimized parameters. The number of reads is automatically aggregated, and subsequently processed data, tabulation chart, and graphs can be readily downloaded.

Number of Reads, Error Rates, and Nonproductive Reads

The present inventors performed high throughput sequencing on TCRα and TCRβ genes in PBMCs derived from 20 healthy individuals. A total of 172,109 and 91,234 sequence reads were assigned to TCRα and TCRβ repertoire analysis, respectively, by using the RG program (Tables 4-2 and 4-3).

TABLE 4-2

Number of unique reads, nucleotides and reads obtained from PBMCs of 20 healthy individuals

| Healthy individuals | Total number of unique reads | Total number of reads | Total number of nucleotides | Average number of nucleotides per read |
|---|---|---|---|---|
| H001 | 5,902 | 8,805 | 3,732,329 | 423.9 |
| H002 | 2,809 | 5,812 | 2,477,523 | 426.3 |
| H003 | 1,707 | 7,334 | 3,269,817 | 445.8 |
| H004 | 5,586 | 6,981 | 3,047,583 | 436.6 |
| H005 | 3,250 | 5,815 | 2,507,968 | 431.3 |
| H006 | 4,267 | 7,043 | 3,052,709 | 433.4 |
| H007 | 5,467 | 6,462 | 2,784,462 | 430.9 |
| H008 | 3,350 | 6,206 | 2,700,726 | 435.2 |
| H009 | 4,966 | 7,267 | 3,119,902 | 429.3 |
| H010 | 5,019 | 6,641 | 2,861,613 | 430.9 |
| H011 | 8,327 | 16,254 | 6,188,290 | 380.7 |
| H012 | 2,289 | 7,203 | 2,386,452 | 331.3 |
| H013 | 3,025 | 6,118 | 2,185,135 | 357.2 |

TABLE 4-2-continued

Number of unique reads, nucleotides and reads obtained from PBMCs of 20 healthy individuals

| Healthy individuals | Total number of unique reads | Total number of reads | Total number of nucleotides | Average number of nucleotides per read |
|---|---|---|---|---|
| H014 | 2,221 | 5,790 | 2,237,670 | 386.5 |
| H015 | 3,976 | 7,009 | 2,944,857 | 420.2 |
| H016 | 8,152 | 20,493 | 8,147,320 | 397.6 |
| H017 | 1,565 | 3,244 | 1,042,278 | 321.3 |
| H018 | 6,303 | 14,768 | 6,169,277 | 417.7 |
| H019 | 10,001 | 17,719 | 7,165,649 | 404.4 |
| H020 | 3,052 | 5,145 | 2,096,401 | 407.5 |
| Mean | 4,561.7 | 8,605.5 | 3,505,898 | 407.4 |
| SD | 2,326.4 | 4,693.4 | 1,870,983 | 35.4 |
| Total number | 91.234 | 172.109 | 7,011.7961 | |

PBMC, peripheral blood mononuclear cells;
SD, standard deviation

TABLE 4-3

Number of unique reads, nucleotides and reads obtained from PBMCs of 20 healthy individuals

| Healthy individuals | Total number of unique reads | Total number of reads | Total number of nucleotides | Average number of nucleotides per read |
|---|---|---|---|---|
| H001 | 3,092 | 4,007 | 1,626,917 | 406.0 |
| H002 | 2,069 | 3,624 | 1,620,164 | 447.1 |
| H003 | 979 | 3,602 | 1,595,988 | 443.1 |
| H004 | 3,025 | 3,664 | 1,637,322 | 446.9 |
| H005 | 1,275 | 1,970 | 884,000 | 448.7 |
| H006 | 1,274 | 2,122 | 952,553 | 448.9 |
| H007 | 3,301 | 3,760 | 1,665,584 | 443.0 |
| H008 | 2,089 | 3,956 | 1,737,410 | 439.2 |
| H009 | 2,664 | 3,575 | 1,595,609 | 446.3 |
| H010 | 2,761 | 3,384 | 1,517,514 | 448.4 |
| H011 | 5,198 | 8,182 | 3,369,499 | 411.8 |
| H012 | 4,882 | 11,759 | 4,421,616 | 376.0 |
| H013 | 4,272 | 8,117 | 2,793,454 | 344.1 |
| H014 | 2,119 | 4,652 | 1,578,364 | 339.3 |
| H015 | 3,735 | 5,298 | 1,929,452 | 364.2 |
| H016 | 2,663 | 4,086 | 1,582,494 | 387.3 |
| H017 | 2,348 | 4,341 | 1,676,546 | 386.2 |
| H018 | 3,044 | 4,807 | 1,804,197 | 375.3 |
| H019 | 4,317 | 5,923 | 2,285,404 | 385.9 |
| H020 | 2,875 | 4,099 | 1,639,809 | 400.1 |
| Mean | 2,899.1 | 4,746.4 | 1,895,695 | 409.4 |
| SD | 1,156.2 | 2,280.0 | 806,581 | 37.8 |
| Total number | 57,982 | 94,928 | 37,913,896 | |

PBMC, peripheral blood mononuclear cells;
SD, standard deviation

Total of 94,928 and 57,982 unique sequence reads (USR) were identified in TCRα and TCRβ, respectively. The number of nucleotide sequences per read obtained by Roche 454 sequencing was a length of about 400 bp (mean by length±SD, TCRα: 407.4±35.4, TCRβ: 409.4±37.8), showing that the sequences are of sufficient length to identify a TCR gene in the range from V to J regions. To assess the precision and quality of NGS sequencing, the inventors have calculated the frequency of mismatching nucleotides between a query sequence and a reference sequence as the error rate. The error rate was 0.72±0.18% for TRAV, 0.54±0.08% for TRAJ, 0.70±0.15% for TRBV, and 0.50±0.12% for TRBJ (Table 4-4).

TABLE 4-4

Percentage of mismatching nueotides in TCR sequence

| Healthy individual | Mismatching nucleotide % | | | |
|---|---|---|---|---|
| | TRAV | TRAJ | TRBV | TRBJ |
| H001 | 0.54 | 0.40 | 0.58 | 0.54 |
| H002 | 0.92 | 0.61 | 0.89 | 0.36 |
| H003 | 0.93 | 0.63 | 0.83 | 0.36 |
| H004 | 0.93 | 0.60 | 0.85 | 0.40 |
| H005 | 0.87 | 0.61 | 0.90 | 0.37 |
| H006 | 0.89 | 0.56 | 0.77 | 0.34 |
| H007 | 0.89 | 0.59 | 0.80 | 0.46 |

TABLE 4-4-continued

Percentage of mismatching nueotides in TCR sequence

| Healthy individual | Mismatching nucleotide % | | | |
|---|---|---|---|---|
| | TRAV | TRAJ | TRBV | TRBJ |
| H008 | 0.89 | 0.61 | 0.89 | 0.49 |
| H009 | 0.93 | 0.63 | 0.91 | 0.39 |
| H010 | 0.88 | 0.61 | 0.85 | 0.35 |
| H011 | 0.54 | 0.48 | 0.54 | 0.52 |
| H012 | 0.58 | 0.65 | 0.61 | 0.69 |
| H013 | 0.58 | 0.56 | 0.57 | 0.64 |
| H014 | 0.68 | 0.48 | 0.54 | 0.59 |
| H015 | 0.65 | 0.40 | 0.57 | 0.70 |
| H016 | 0.55 | 0.50 | 0.57 | 0.59 |
| H017 | 0.57 | 0.53 | 0.57 | 0.57 |
| H018 | 0.51 | 0.47 | 0.56 | 0.53 |
| H019 | 0.53 | 0.44 | 0.63 | 0.66 |
| H020 | 0.47 | 0.43 | 0.54 | 0.50 |
| Mean | 0.72 | 0.54 | 0.70 | 0.50 |
| SD | 0.18 | 0.08 | 0.15 | 0.12 |

SD, standard deviation

The error rates were slightly lower than the mean error rate of 1.07% for the 454-sequence reported in a previous study (Gilles A et al. (2011) BMC Genomics 12: 245). The error rate was significantly higher in a V region than in a J region (AV vs. AJ: p<0.05, BV vs. BJ: p<0.0001). Higher sequence reliability was exhibited in a region closed to a sequencing primer. The frequency of read frame shift (out-of-frame) in a CDR3 region or a nonproductive read having a stop codon was calculated (Table 4-5).

TABLE 4-5

Frequency of out-of-frame unique sequence reads of TCRα and TCRβ

| Healthy individual | Frequency % | |
|---|---|---|
| | TCRα | TCRβ |
| H001 | 21.9 | 27.0 |
| H002 | 35.8 | 26.1 |
| H003 | 52.3 | 42.7 |
| H004 | 27.8 | 20.7 |
| H005 | 33.8 | 22.3 |
| H006 | 31.8 | 19.8 |
| H007 | 28.6 | 19.5 |
| H008 | 31.0 | 27.4 |
| H009 | 31.2 | 21.5 |
| H010 | 30.6 | 19.1 |
| H011 | 29.1 | 27.5 |
| H012 | 41.5 | 46.0 |
| H013 | 33.4 | 38.1 |
| H014 | 29.4 | 39.4 |
| H015 | 21.1 | 34.3 |
| H016 | 34.3 | 32.1 |
| H017 | 32.7 | 33.2 |
| H018 | 27.9 | 29.2 |
| H019 | 27.4 | 32.1 |
| H020 | 21.7 | 28.3 |
| Mean | 31.2 | 29.3 |
| SD | 7.0 | 7.9 |

SD, standard deviation

There was no significant difference in the percentage of frequency of a nonproductive unique sequence read between TCRα and TCRβ (31.2±7.0% vs. 29.3±7.9%, P=0.31).

Expression of TCR Gene Comprising ORF and Pseudogene

Figure 51:
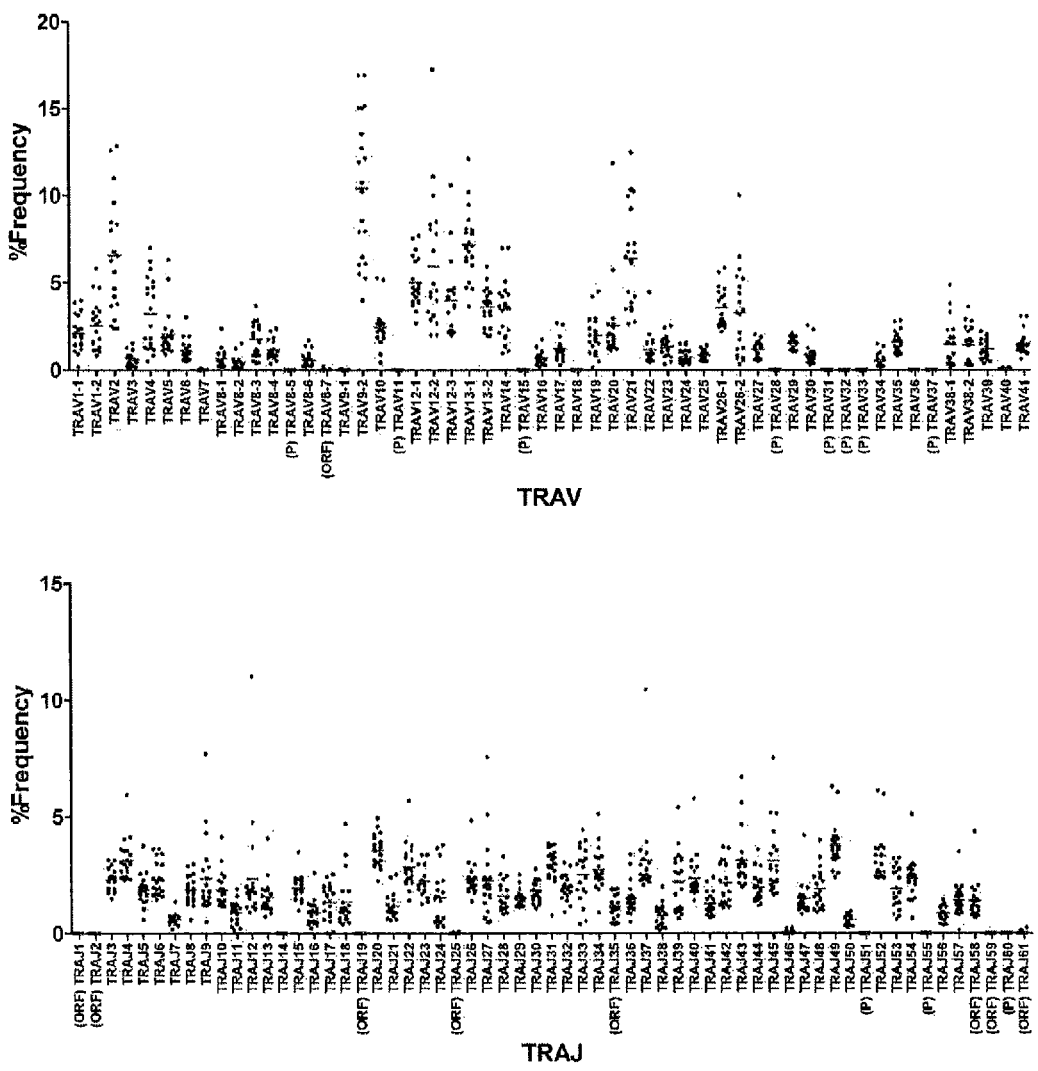
FIG. 51 shows the use of TRAV and TRAJ in 20 healthy individuals. The number of TCR sequences having each of TRAV and TRAJ was counted. The frequency percentages of 54 TRAV and 61 TRAJ were calculated and shown as scatter diagrams. Each dot indicates a frequency percentage of TRAV or TRAJ in each individual. The horizontal line indicates the mean value of 20. (P): pseudogene, (ORF): Open Reading Frame.
Figure 52:
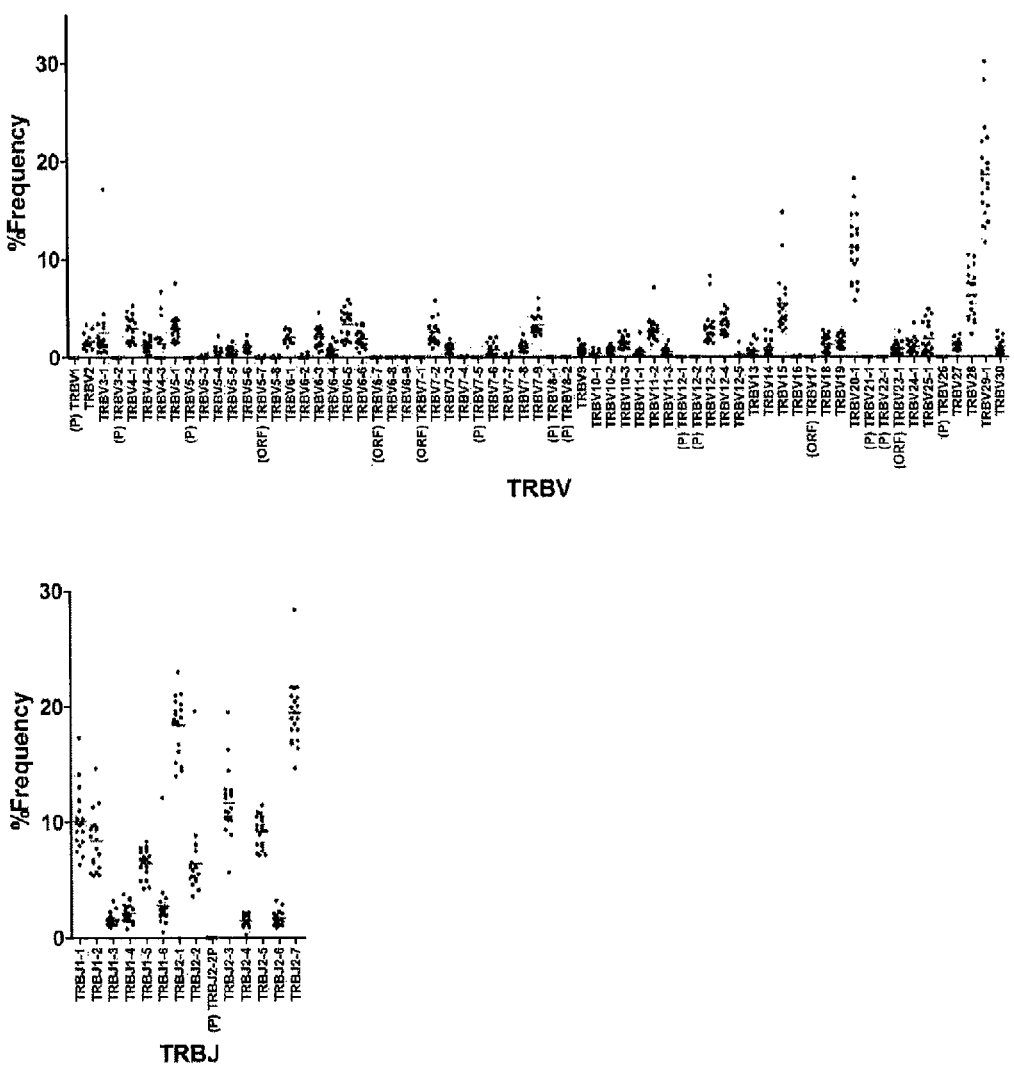
FIG. 52 shows the use of TRBV and TRBJ in 20 healthy individuals. The frequency percentages of 65 TRBV and 14 TRBJ are shown as scatter diagrams. Each dot indicates a frequency percentage of TRBV or TRBJ in each individual. The red bar indicates the mean value. (P): pseudogene, (ORF): Open Reading Frame.

To determine the use of TRV and TRJ genes in a TCR sequencing read, the number of copies of USR having TRV or TRJ (number of reads) was each counted. Individual USRs were ranked in the order of number of copies. The frequency percentage of each of TRV and TRJ was calculated (FIG. 51 and FIG. 52). For a TCRα repertoire, 8 pseudogenes (AV8-5, AV11, AV15, AV28, AV31, AV32, AV33 and AV37) were not expressed in healthy individuals. AV8-7 classified as an ORF (defined based on a change in regulatory element, recombinant signal and/or splicing site by IMGT) was hardly expressed (43 reads in 11 out of 20 individuals). Expression of AV18 and AV36 (classified as a functional gene) was not observed in healthy individuals. Furthermore, functional genes AV7 and AV9-1 were not sufficiently expressed in one individual (9 reads) and 2 individuals (3 reads). Expression of AJ35 and AJ58 among 8 AJ genes classified as ORF genes (AJ1, AJ2, AJ19, AJ25, AJ35, AJ58 and AJ61) was observed in all 20 individuals. AJ25 and AJ61 thereamong were expressed slightly in 3 individuals (21 reads) and 7 individuals (35 reads), respectively. AJ1, AJ2, AJ19 and AJ59 were not present in any individual. Expression of three pseudogenes AJ51, AJ55 and AJ60 was not present in any individual. Only 3 reads of the functional gene AJ14 were detected from 3 individuals.

For a TCRβ gene, there was no expression of 11 pseudogenes (BV1, BV3-2, BV5-2, BV7-5, BV8-1, BV8-2, BV12-1, BV12-2, BV21-1, BV22-1, and BV26) in healthy individuals. Among 5 ORF genes, BV5-7 (32 reads in 13 individuals), BV6-(13 reads in 8 individuals), and BV17 (3 reads in 1 individuals) were not sufficiently expressed. A BV7-1 ORF gene was not observed in any individual, while BV23-1 was expressed in all 20 individuals. For a BJ gene, there was no expression of a BJ2-2P pseudogene.

Recombination of TRAV and TRAJ at a Low Frequency

Figure 53:
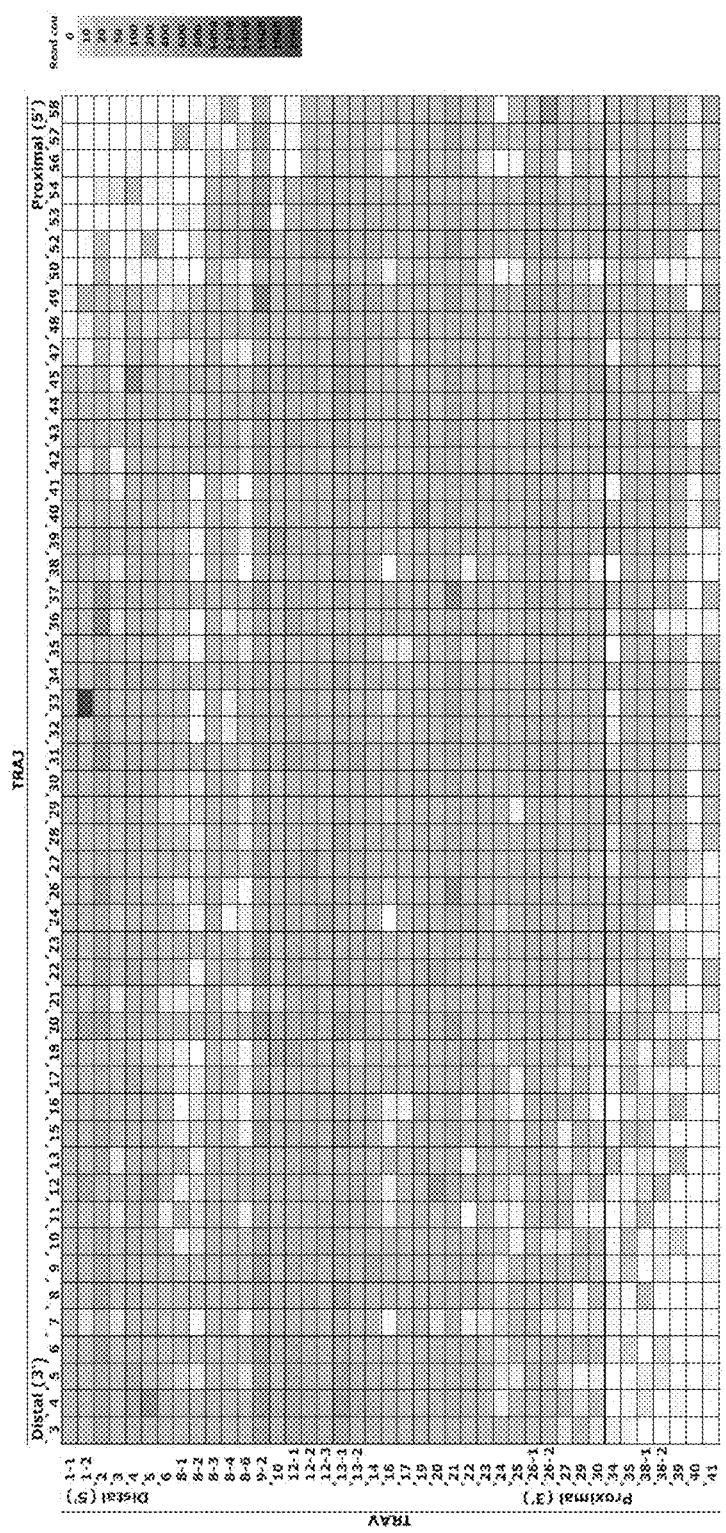
FIG. 53 shows the frequency of incidents of genetic recombination in TRAV at TRAJ in read data pooled from 20 healthy individuals. The number of TCR sequence reads having genetic recombination was counted for each of TRAV and TRAJ. The tendency of incidents of recombination is visualized by displaying a heat map of the number of each recombination. The color of each pixel indicates the number of each recombination. For TRAV, 8 psuedogenes (TRAV8-5, TRAV11, TRAV15, TRAV28, TRAV31, TRAV32, TRAV33 and TRAV37) and 1 ORF (TRAV8-7), and genes that were not sufficiently expressed (TRAV7, TRAV9-1, TRAV18 and TRAV36) were excluded. For TRAJ, 3 pseudogenes (TRAJ51, TRAJ55, and TRAJ60), 6 ORFs (TRAJ1, TRAJ2, TRAJ19, TRAJ25, TRAJ59, and TRAJ61), and genes that were not sufficiently expressed (TRAJ14 and TRAJ46) were excluded. 2 ORFs (TRAJ35 and TRAJ48) found to have been expressed were included. The display shows a heat map of 2050 recombination events (41 TRAV×50 TRAJ).

Genetic recombination with 41 TRAV and 50 TRAJ (excluding pseudogenes, ORF and genes that are not sufficiently expressed) can generate a total of 2050 AV-AJ recombinations (FIG. 53). Among them, 1969 AV-AJ recombinations (96.0%) were detected in 20 individuals. This indicates that almost all AV-AJ recombinations were used in TCR transcripts without limitation. In particular, AV1-1 to AV6 genes could not be preferentially recombined with AJ50 to AJ58. Similarly, recombination of AV35 to AV41 genes with AJ3 to AJ16 was hardly observed. Considering the position of these gene segments on a chromosome, the results indicate that an AV-AJ recombination hardly occurs between a proximal AV gene and a distal AJ gene and between a distal AV gene and a proximal AJ gene.

For TCRβ, 650 gene recombinations are generated by 50 BV (excluding 11 pseudogenes and 5 ORF) and 13 BJ genes (excluding pseudogenes). 605 BV-BJ (93.1%) thereamong were used in 30 individuals. There was no limit for combination of TRBV with TRBJ.

Preferential use of TRV and TRJ repertoires in healthy individuals

To elucidate the use of TRV and TRJ in all TRC transcripts, the frequency of USR having TRV or TRJ was each calculated (FIG. 51 and FIG. 52). Preferential use in some TRAV genes was similar to previous results (6) obtained by using a quantitative assay based on hybridization. Some TRBV genes were used more in a TRBV repertoire. The top 3, TRAV9-2 (BV4S1 by Arden), TRBV20-1 (BV2S1) and TRBV28 (BV3S1), accounted for ⅓ of all sequence reads. This was similar to the result (6) obtained in a previous study by the inventors using a microplate hybridization assay. Use of a gene significantly varied among TRBJ genes. TRBJ2-1 and TRBJ2-7 were very highly expressed, while expression of TRBJ1-3, TRBJ1-4, TRBJ1-6, TRBJ2-4 and TRBJ2-6 was low.

3 Dimensional (3D) View of the Use of TCR Repertoire

Figure 54:
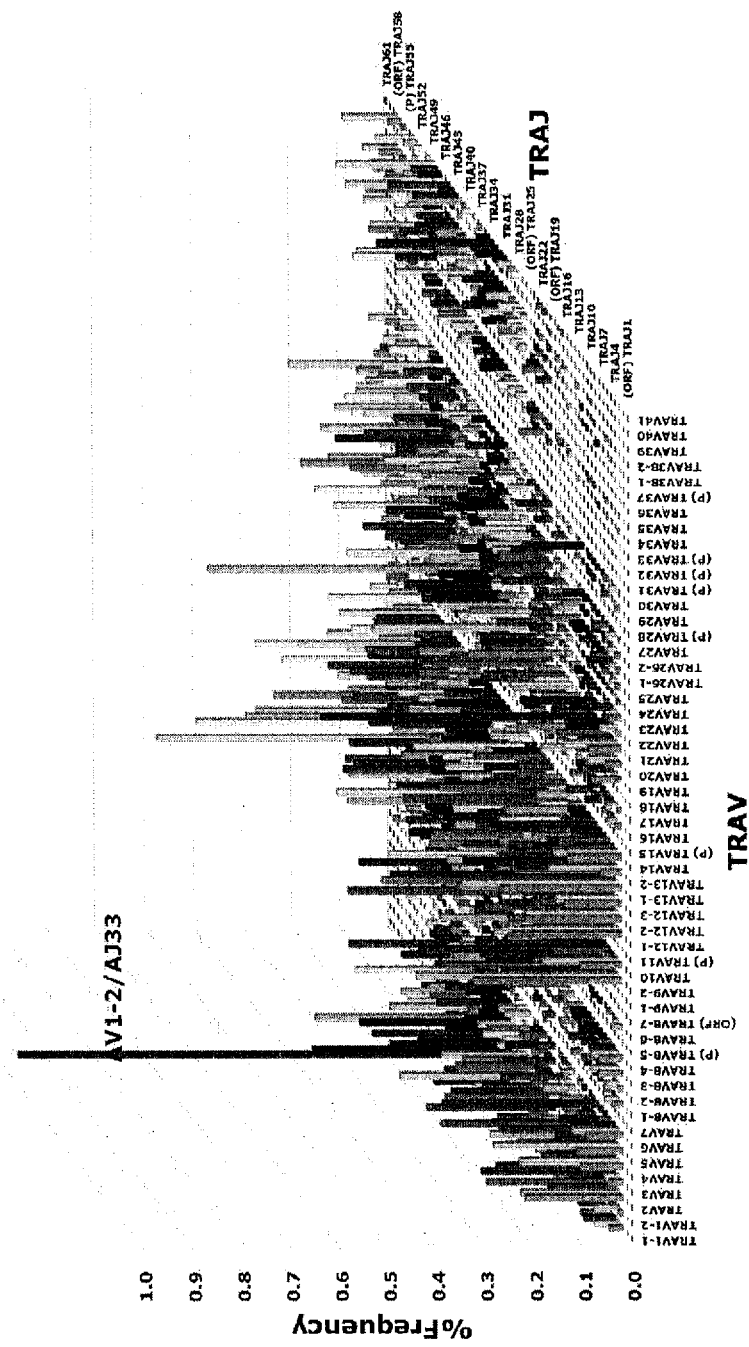
FIG. 54 shows a 3D image of a TCRα repertoire. The number of TCR sequence reads having a predetermined genetic recombination of TRAV in TRAJ was counted. 3294 (54 TRAV×61 TRAJ) mean frequency percentages in 20 healthy individuals are shown as a 3D bar graph. X axis and Y axis indicate TRAV and TRAJ, respectively. Recombination of TRAV1-2 in TRAJ33 (AV1-2/AJ33) was the most expressed (0.99±0.85). (P): pseudogene, (ORF): Open Reading Frame.
Figure 55:
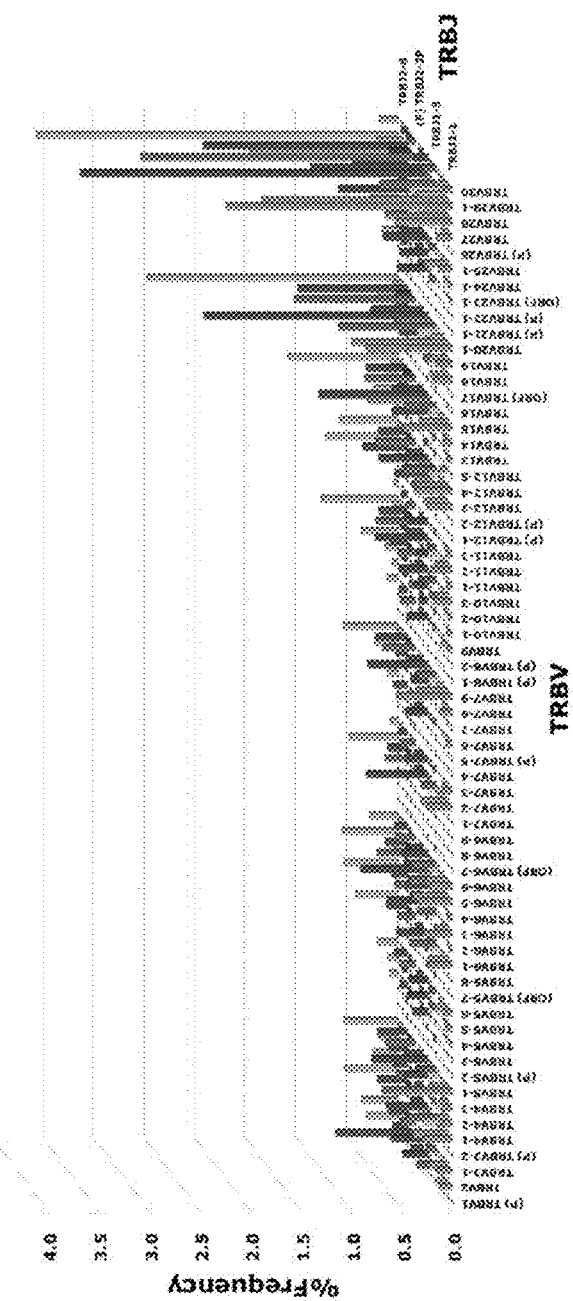
FIG. 55 shows a 3D image of a TCRβ repertoire. The number of TCR sequence reads having a predetermined genetic recombination of TRBV in TRBJ was counted. 910 (65 TRBV×14 TRBJ) mean frequency percentages in 20 healthy individuals are shown as a 3D bar graph. X axis and Y axis indicate TRBV and TRBJ, respectively. (P): pseudogene, (ORF): Open Reading Frame.

To visualize the use of TCRs having a combination of a TRV gene and a TRJ gene, the inventors made a 3D portrayal of a TCR repertoire (FIG. 54 and FIG. 55). The advantage of a 3D image is that the level of diversity of TCRs and predominance of a specific combination of a TRV gene and a TRJ gene can be readily observed. For TCRβ, there was hardly any preferential use of recombination between a TRVB gene and a TRBJ gene. The frequency of each recombination was dependent on the use of TRBV or TRBJ. BV29-1/BJ2-7, BV29-1/BJ2-1, BV29-1/BJ2-3 and BV20-1/BJ2-7 were used at a high frequency in all combinations, while others were expressed at a low frequency. In contrast, 3D imaging of a TCRα repertoire showed expression of TRAV and TRAJ at a low level in a wide distribution. The share was less than 1% in all combinations. Notably, TCR reads having AV1-2 and AJ33 were highly expressed in all healthy individuals (mean±SD: 0.99±0.85).

Digital CDR3 Chain Length Distribution

Figure 56:
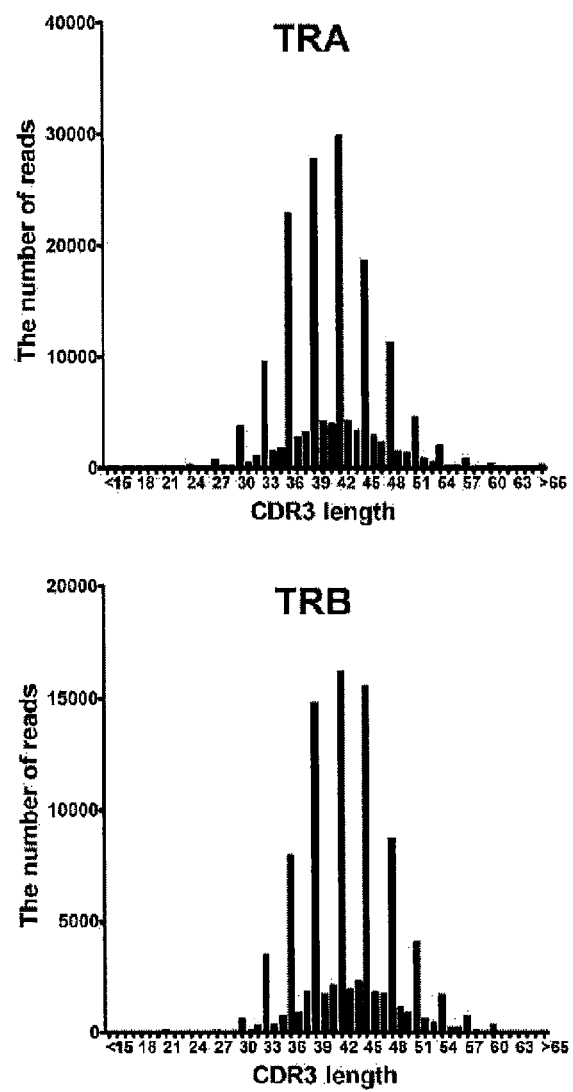
FIG. 56 shows digital CDR3 chain length distributions for TCRα and TCRβ. The length of CDR3 was determined for 172109 TCRα and 94928 TCR sequence reads obtained from data pooled from 20 individuals. The length of a nucleotide sequence from conserved cysteine at position 104 (Cys104) (naming by IMGT) to conserved phenylalanine at position 118 (Phe118) was automatically calculated by using an RG software. The distributions of CDR3 chain lengths in TCRα (top) and TCRβ (bottom) are shown as a histogram.

CDR3 chain length distribution analysis called CDR3 size spectratyping (Yassai M et al. (2000) J Immunol 165: 3706-3712; Yassai M et al. (2002) J Immunol 168: 3801-3807) or immunoscope analysis (Pannetier C et al. (1993) Proc Natl Acad Sci USA 90: 4319-4323; Pannetier C et al. (1995) Immunol Today 16: 176-181) was efficiently used to estimate the diversity of a TCR repertoire. The technique is based on actual peak distribution of PCR amplicons comprising a CDR3 sequence with gel electrophoresis. In the present study, a determined nucleotide sequence length of a TCR in the range from the conserved Cys 104 (named by IMGT) to conserved phenylalanine at position 118 (Phe118) was automatically calculated. This provides a visibly simple method for estimating the diversity and clonality of a TCR by using NGS data. RG can generate a diagram representing a digital CDR3 chain length distribution for each V region. The CDR3 chain length distribution of both TCRα and TCRβ was similar to a common distribution, but was not necessarily completely symmetric (FIG. 56). The CDR3 chain length is shorter in TCRα than in TCRβ (mean±SD: 41.2±8.3 vs. 42.8±6.1). TCRα has a positive skewness relative to TCRβ (skewness index: 11.1 vs 5.41), indicating that the distribution in TCRα was concentrated on the left side. Furthermore, TCRα had a positive kurtosis relative to TCRβ, indicating high kurtosis in TCRα (kurtosis index: 282.4 to 176.7).

Diversity of TCRα and TCRβ Repertoires

Figure 57:
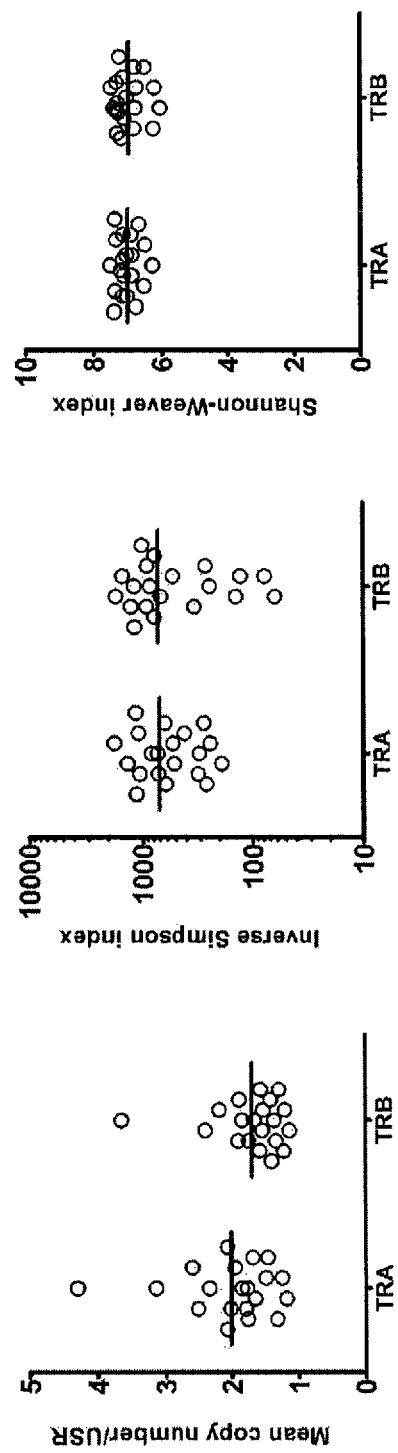
FIG. 57 shows diversity of TCRα and TCRβ repertoires in healthy individuals. The number of copies (number of reads) of unique sequence reads (USR) was calculated. The mean number of copies per unique sequence read in each individual is shown as a white circle (left). The inverse Simpson index (middle) and Shannon-Weaver index (right) were calculated by using an R program in accordance with the equation described in the Materials and Methods section in Example 5 of the analysis system. Each white circle indicates an index for an individual. There was no significant difference in the mean number of copies, inverse Simpson index or Shannon-Weaver index between TCRα and TCRβ.

To show the diversity of a TCR repertoire, the inventors calculated the diversity index (Simpson's index, Shannon-Weaver's index or the like) and the average number of copies of USRs (FIG. 57). The average number of copies of USRs significantly differed between TCRα and TCRβ (2.0±0.72 to 1.70±0.57). Furthermore, there was no significant difference in the inverse Simpson's index (D) or Shannon-Weaver's index (H) between TCRα and TCRβ (D: 710.3±433.0 to 729.7±493.9, H: 7.02±0.33 vs 6.97±0.43). The results show that there is no difference in immunodiversity for TCRα and TCRβ in healthy individuals.

Similarity of TCRα and TCRβ Repertoires Among Healthy Individuals

Figure 60:
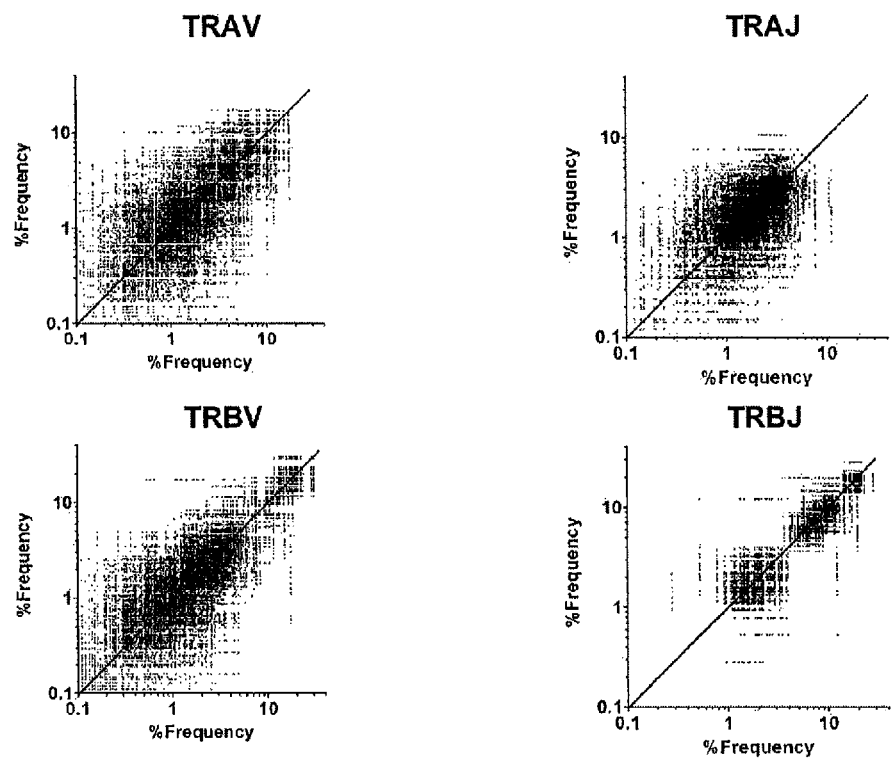
FIG. 60 shows the correlation of gene use of TRAV, TRAJ, TRBV, and TRBJ among healthy individuals. The frequency percentages of TRAV (top left), TRAJ (top right), TRBV (bottom left) and TRBJ (bottom right) between all pairs of individuals are plotted. A dot that is offset below the diagonal line (y=x) indicates better correlation.
Figure 61:
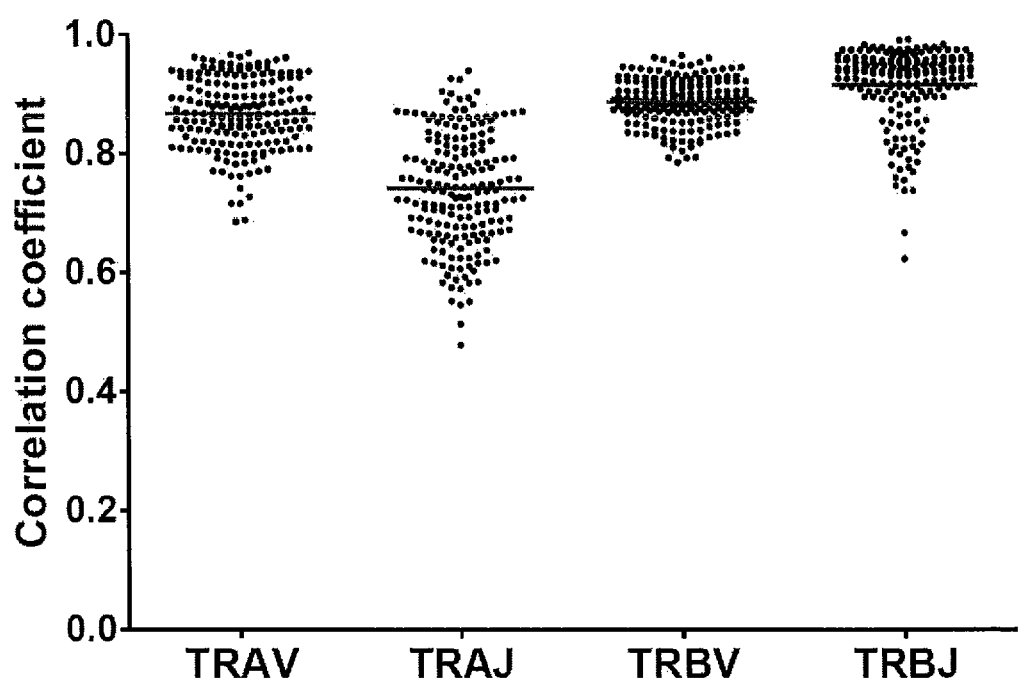
FIG. 61 shows matching correlation coefficients in TRAV, TRAJ, TRBV, and TRBJ. A correlation coefficient between two samples derived from healthy individuals was calculated by Spearman's correlation test. Each dot indicates a correlation coefficient value between pairs of individuals. The mean correlation coefficient is indicated by a horizontal line (n=190).

To elucidate the correlation of use of genes among individuals, the frequency percentages of each of TRV and TRJ were plotted for all individual pairs by a scatter plot (FIG. 60). The Spearman's correlation coefficient between each pair was calculated. A matching correlation coefficient was lower in TRAV than in TRBV (mean±SD, 0.86±0.059 for TRAV, 0.89±0.038 for TRBV, p<0.001), and lower in TRAJ than in TRBJ (0.74±0.095 for TRAJ, 0.91±0.063 for TRBJ, p<0.001). The results show that the expression level of TRV and TRJ among healthy individuals was more similar among individuals in TCRβ relative to TCRα.

To assess the potential similarity of TCR repertoires at a clone level among healthy individuals, the inventors searched for a TCR sequence read shared among individuals. The number of TCR reads shared was counted for all pairs of individuals to calculate the frequency thereof (Table 4-6 and Table 4-7).

TABLE 4-6

Percentage of frequency of TCRα reads shared among all pairs of healthy individuals

| | H001 | H002 | H003 | H004 | H005 | H006 | H007 | H008 | H009 | H010 | H011 | H012 | H013 | H014 | H015 | H016 | H017 | H018 | H019 | H020 |
|---|---|---|---|---|---|---|---|---|---|---|---|---|---|---|---|---|---|---|---|---|
| H001 | — | 0.71 | 0.29 | 1.04 | 1.29 | 0.80 | 1.61 | 0.78 | 0.89 | 0.84 | 1.12 | 0.87 | 0.73 | 0.77 | 1.28 | 0.92 | 0.77 | 1.05 | 1.13 | 1.11 |
| H002 | 0.34 | — | 0.47 | 0.59 | 0.37 | 0.37 | 0.51 | 0.27 | 0.72 | 0.36 | 0.23 | 0.31 | 0.26 | 0.23 | 0.25 | 0.33 | 0.32 | 0.35 | 0.26 | 0.46 |
| H003 | 0.08 | 0.28 | — | 0.21 | 0.15 | 0.23 | 0.04 | 0.21 | 0.16 | 0.12 | 0.08 | 0.13 | 0.10 | 0.00 | 0.15 | 0.07 | 0.19 | 0.10 | 0.10 | 0.13 |
| H004 | 0.98 | 1.17 | 0.70 | — | 1.05 | 1.05 | 1.32 | 1.35 | 1.41 | 1.24 | 0.82 | 1.00 | 0.79 | 0.68 | 1.26 | 0.72 | 0.83 | 0.78 | 0.78 | 0.79 |
| H005 | 0.71 | 0.43 | 0.29 | 0.61 | — | 0.89 | 0.90 | 0.84 | 0.79 | 0.74 | 0.59 | 0.66 | 0.50 | 0.45 | 0.80 | 0.58 | 0.89 | 0.71 | 0.53 | 0.69 |
| H006 | 0.58 | 0.57 | 0.59 | 0.81 | 1.17 | — | 1.01 | 0.63 | 1.07 | 0.92 | 0.82 | 1.05 | 0.63 | 0.54 | 0.93 | 0.75 | 0.89 | 0.75 | 0.57 | 0.75 |
| H007 | 1.49 | 1.00 | 0.12 | 1.29 | 1.51 | 1.29 | — | 1.13 | 1.81 | 1.28 | 0.94 | 1.00 | 0.69 | 1.04 | 1.58 | 0.88 | 1.28 | 1.14 | 1.05 | 1.05 |
| H008 | 0.44 | 0.32 | 0.41 | 0.75 | 0.86 | 0.49 | 0.70 | — | 0.58 | 0.66 | 0.36 | 0.48 | 0.26 | 0.36 | 0.68 | 0.47 | 0.32 | 0.41 | 0.38 | 0.43 |
| H009 | 0.75 | 1.28 | 0.47 | 1.25 | 1.20 | 1.24 | 1.19 | 0.87 | — | 1.18 | 0.77 | 0.87 | 0.63 | 0.63 | 1.18 | 0.80 | 0.89 | 0.81 | 0.60 | 0.92 |
| H010 | 0.71 | 0.64 | 0.35 | 1.11 | 1.14 | 1.08 | 1.17 | 0.99 | 1.19 | — | 0.90 | 0.96 | 0.79 | 0.59 | 1.16 | 0.74 | 0.64 | 0.95 | 0.86 | 0.85 |
| H011 | 1.58 | 0.68 | 0.41 | 1.22 | 1.51 | 1.59 | 1.43 | 0.90 | 1.29 | 1.49 | — | 1.66 | 6.02 | 0.99 | 2.04 | 1.37 | 1.21 | 1.52 | 1.49 | 1.38 |
| H012 | 0.34 | 0.25 | 0.18 | 0.41 | 0.46 | 0.56 | 0.42 | 0.33 | 0.40 | 0.44 | 0.46 | — | 0.36 | 0.09 | 0.58 | 0.44 | 0.58 | 0.48 | 0.42 | 0.36 |
| H013 | 0.37 | 0.28 | 0.18 | 0.43 | 0.46 | 0.45 | 0.38 | 0.24 | 0.38 | 0.48 | 2.19 | 0.48 | — | 0.41 | 0.58 | 0.33 | 0.38 | 0.38 | 0.46 | 0.56 |
| H014 | 0.29 | 0.18 | 0.00 | 0.27 | 0.31 | 0.28 | 0.42 | 0.24 | 0.28 | 0.26 | 0.26 | 0.09 | 0.30 | — | 0.50 | 0.33 | 0.26 | 0.17 | 0.35 | 0.29 |
| H015 | 0.86 | 0.36 | 0.35 | 0.90 | 0.98 | 0.87 | 1.15 | 0.81 | 0.95 | 0.92 | 0.97 | 1.00 | 0.76 | 0.90 | — | 0.82 | 0.89 | 0.84 | 0.95 | 0.85 |
| H016 | 1.27 | 0.96 | 0.35 | 1.06 | 1.45 | 1.43 | 1.33 | 1.13 | 1.31 | 1.20 | 1.35 | 1.57 | 0.89 | 1.22 | 1.69 | — | 0.83 | 1.19 | 1.20 | 0.66 |
| H017 | 0.20 | 0.18 | 0.18 | 0.23 | 0.43 | 0.23 | 0.37 | 0.15 | 0.28 | 0.20 | 0.23 | 0.39 | 0.20 | 0.18 | 0.35 | 0.16 | — | 0.17 | 0.20 | 0.26 |
| H018 | 1.12 | 0.78 | 0.35 | 0.88 | 1.38 | 1.10 | 1.32 | 0.78 | 1.03 | 1.20 | 1.15 | 1.31 | 0.29 | 0.50 | 1.33 | 0.92 | 0.70 | — | 1.18 | 0.92 |
| H019 | 1.91 | 0.93 | 0.59 | 1.40 | 1.63 | 1.34 | 1.92 | 1.13 | 1.21 | 1.71 | 1.79 | 1.83 | 1.52 | 1.58 | 2.39 | 1.47 | 1.28 | 1.87 | — | 1.77 |
| H020 | 0.58 | 0.50 | 0.23 | 0.43 | 0.65 | 0.54 | 0.59 | 0.39 | 0.56 | 0.52 | 0.50 | 0.48 | 0.56 | 0.41 | 0.65 | 0.25 | 0.51 | 0.44 | 0.54 | — |

TABLE 4-7

Percentage of frequency of TCRβ reads shared among all pairs of healthy individuals

|  | H001 | H002 | H003 | H004 | H005 | H006 | H007 | H008 | H009 | H010 | H011 | H012 | H013 | H014 | H015 | H016 | H017 | H018 | H019 | H020 |
|---|---|---|---|---|---|---|---|---|---|---|---|---|---|---|---|---|---|---|---|---|
| H001 | — | 0.05 | 0.00 | 0.00 | 0.08 | 0.00 | 0.03 | 0.05 | 0.11 | 0.07 | 0.08 | 0.02 | 0.05 | 0.00 | 0.00 | 0.11 | 0.00 | 0.00 | 0.12 | 0.07 |
| H002 | 0.03 | — | 0.00 | 0.03 | 0.08 | 0.00 | 0.00 | 0.05 | 0.04 | 0.00 | 0.02 | 0.02 | 0.00 | 0.00 | 0.00 | 0.04 | 0.04 | 0.00 | 0.02 | 0.00 |
| H003 | 0.00 | 0.00 | — | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.02 | 0.00 |
| H004 | 0.00 | 0.05 | 0.00 | — | 0.16 | 0.00 | 0.03 | 0.05 | 0.08 | 0.07 | 0.00 | 0.02 | 0.00 | 0.05 | 0.00 | 0.08 | 0.04 | 0.03 | 0.02 | 0.00 |
| H005 | 0.03 | 0.05 | 0.00 | 0.07 | — | 0.00 | 0.00 | 0.00 | 0.04 | 0.00 | 0.00 | 0.00 | 0.00 | 0.00 | 0.03 | 0.04 | 0.04 | 0.00 | 0.00 | 0.03 |
| H006 | 0.00 | 0.00 | 0.00 | 0.00 | 0.00 | — | 0.03 | 0.00 | 0.04 | 0.04 | 0.02 | 0.02 | 0.00 | 0.05 | 0.11 | 0.04 | 0.04 | 0.00 | 0.02 | 0.00 |
| H007 | 0.03 | 0.00 | 0.00 | 0.03 | 0.00 | 0.08 | — | 0.05 | 0.04 | 0.04 | 0.02 | 0.02 | 0.00 | 0.00 | 0.00 | 0.04 | 0.00 | 0.00 | 0.00 | 0.03 |
| H008 | 0.03 | 0.05 | 0.00 | 0.03 | 0.00 | 0.00 | 0.03 | — | 0.00 | 0.04 | 0.02 | 0.00 | 0.00 | 0.00 | 0.03 | 0.11 | 0.00 | 0.00 | 0.02 | 0.00 |
| H009 | 0.10 | 0.05 | 0.00 | 0.07 | 0.08 | 0.08 | 0.03 | 0.00 | — | 0.11 | 0.06 | 0.02 | 0.00 | 0.00 | 0.03 | 0.04 | 0.00 | 0.03 | 0.02 | 0.00 |
| H010 | 0.06 | 0.00 | 0.00 | 0.07 | 0.00 | 0.08 | 0.03 | 0.05 | 0.11 | — | 0.00 | 0.02 | 0.00 | 0.09 | 0.03 | 0.11 | 0.00 | 0.00 | 0.07 | 0.07 |
| H011 | 0.13 | 0.05 | 0.00 | 0.00 | 0.00 | 0.08 | 0.03 | 0.05 | 0.11 | 0.00 | — | 0.04 | 0.16 | 0.00 | 0.08 | 0.11 | 0.00 | 0.16 | 0.05 | 0.14 |
| H012 | 0.03 | 0.05 | 0.00 | 0.03 | 0.00 | 0.08 | 0.03 | 0.00 | 0.04 | 0.04 | 0.04 | — | 0.30 | 0.14 | 0.21 | 0.45 | 0.26 | 0.03 | 0.02 | 0.00 |
| H013 | 0.06 | 0.00 | 0.00 | 0.00 | 0.00 | 0.00 | 0.00 | 0.00 | 0.00 | 0.00 | 0.13 | 0.27 | — | 0.14 | 0.16 | 0.19 | 0.13 | 0.03 | 0.02 | 0.03 |
| H014 | 0.00 | 0.00 | 0.00 | 0.03 | 0.00 | 0.08 | 0.00 | 0.00 | 0.00 | 0.07 | 0.00 | 0.06 | 0.07 | — | 0.00 | 0.04 | 0.21 | 0.00 | 0.00 | 0.03 |
| H015 | 0.00 | 0.00 | 0.00 | 0.00 | 0.08 | 0.31 | 0.00 | 0.05 | 0.04 | 0.04 | 0.06 | 0.16 | 0.14 | 0.00 | — | 0.15 | 0.09 | 0.03 | 0.02 | 0.00 |
| H016 | 0.10 | 0.05 | 0.00 | 0.07 | 0.08 | 0.00 | 0.03 | 0.14 | 0.04 | 0.11 | 0.06 | 0.25 | 0.12 | 0.05 | 0.11 | — | 0.13 | 0.03 | 0.02 | 0.03 |
| H017 | 0.00 | 0.05 | 0.00 | 0.03 | 0.08 | 0.08 | 0.00 | 0.00 | 0.00 | 0.00 | 0.00 | 0.12 | 0.07 | 0.24 | 0.05 | 0.11 | — | 0.00 | 0.00 | 0.00 |
| H018 | 0.00 | 0.00 | 0.00 | 0.03 | 0.00 | 0.00 | 0.00 | 0.00 | 0.04 | 0.00 | 0.10 | 0.02 | 0.02 | 0.00 | 0.03 | 0.04 | 0.00 | — | 0.14 | 0.10 |
| H019 | 0.16 | 0.05 | 0.10 | 0.03 | 0.00 | 0.08 | 0.00 | 0.05 | 0.04 | 0.11 | 0.04 | 0.02 | 0.02 | 0.00 | 0.03 | 0.04 | 0.00 | 0.20 | — | 0.10 |
| H020 | 0.06 | 0.00 | 0.00 | 0.00 | 0.08 | 0.00 | 0.03 | 0.00 | 0.00 | 0.07 | 0.08 | 0.00 | 0.02 | 0.05 | 0.00 | 0.04 | 0.00 | 0.10 | 0.07 | — |

Figure 58:
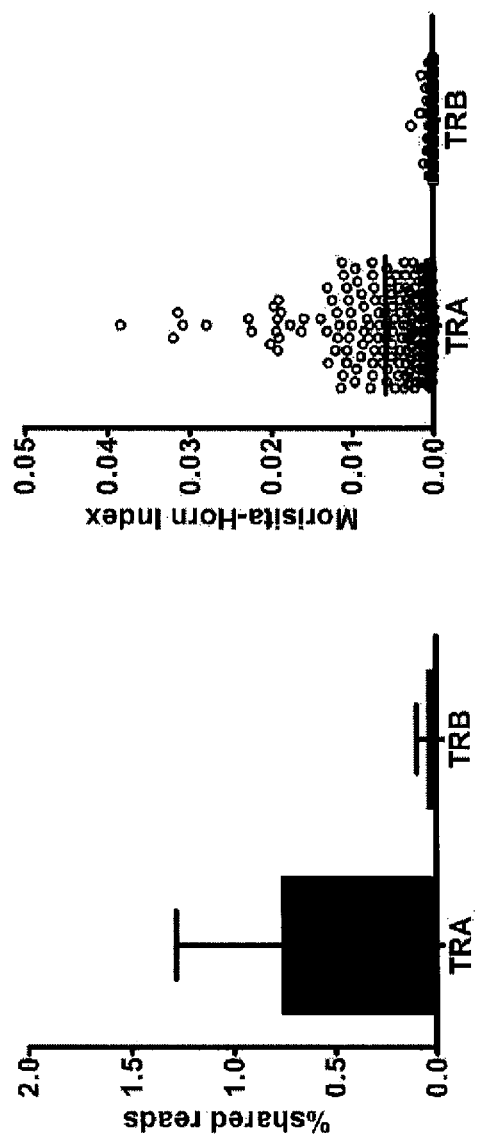
FIG. 58 shows similarity of TCRα and TCRβ repertoires in healthy individuals. The frequency of incidence of TCR sequence reads shared between all pairs of 20 individuals was calculated (Table 4-6 and Table 4-7). The mean frequency percentages of shared leads were compared between TCRα and TCRβ (left, n=380). A Morisita-Horn index, which is a similar index, was calculated by using an R program in accordance with the equation described in the Materials and Methods section in Example 5 of the analysis system. There was no significant difference in similarity indices between TCRα and TCRβ and frequency of shared reads ($p<0.001$ and $p<0.001$, respectively; Mann-Whitney U test).

The mean frequency was significantly higher in TCRα relative to TCR (0.76±0.52 vs 0.040±0.057, n=380, p<0.001) (FIG. 58), indicating that a TCRα repertoire comprises more shared TCR reads among individuals than TCRβ. The Morisita-Horn index, which is a similar index, was significantly larger for TCRα than for TCRβ (0.0058±0.0069 vs 0.000096±0.00029, n=190, P<0.001). The results clearly show that a TCRα repertoire was more similar among healthy individuals relative to a TCRβ repertoire.

TCR Sequence Shared Among Healthy Individuals

A small number of TCR sequences are shared among different healthy individuals. The shared TCR thereof are called public TCRs. In contrast, most TCRs were specific to each healthy individual (private TCR). To identify a public TCR sequence in 20 healthy individuals, the inventors searched for a TCRα read and a TCRβ read shared among two or more healthy individuals. 3,041 public TCRα and 206 public TCR sequences were obtained from 90,643 and 57,982 USRs, respectively, in 20 healthy individuals (Table 4-8).

TABLE 4-8

Number of TCRα and TCRβ sequences shared among multiple healthy individuals

| | Number of shared TCRs | |
|---|---|---|
| Number of individuals | TCRα | TCRβ |
| 2 | 2,390 | 196 |
| 3 | 424 | 9 |
| 4 | 125 | 1 |
| 5 | 47 | 0 |
| 6 | 23 | 0 |
| 7 | 9 | 0 |
| 8 | 4 | 0 |
| 9 | 5 | 0 |
| 10 | 5 | 0 |
| 11 | 2 | 0 |
| 12 | 0 | 0 |
| 13 | 3 | 0 |
| 14 | 1 | 0 |
| 15 | 1 | 0 |
| 16 | 2 | 0 |
| 17 | 0 | 0 |

TABLE 4-8-continued

Number of TCRα and TCRβ sequences shared among multiple healthy individuals

| | Number of shared TCRs | |
|---|---|---|
| Number of individuals | TCRα | TCRβ |
| 18 | 0 | 0 |
| 19 | 0 | 0 |
| 20 | 0 | 0 |
| Total number | 3,041 | 206 |

The number of identical TCR sequences observed in a plurality of healthy individuals (2-20 individuals) was counted.

Figure 59:
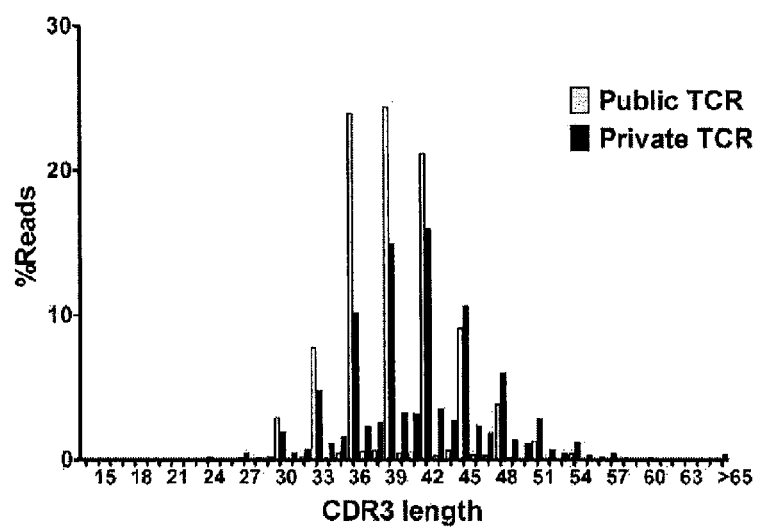
FIG. 59 shows that a public TCR had CDR3 with a shorter chain length than a private TCR. The length of CDR3 was calculated with 7237 USRs (gray) of a public TCE and 83997 USRs (black) of a private TCR. The frequency percentages of USR in each CDR3 length were plotted as a bar graph. The median values of CDR3 lengths in public and private TCRs were 39 and 42, respectively.

Public TCRα was higher in frequency than TCRβ in peripheral blood lymphocytes (PBL) derived from a healthy individual. A public TCRβ sequence was obtained from 2-4 individuals, while a public TCRα sequence was observed in individuals. The results shows that a TCRα public sequence is used more commonly in individuals, but a TCRβ repertoire was more specific to each individual. Furthermore, the frequency per individual of a TCR sequence shared between a pair of individuals was significantly higher for TCRα (7.9%) than for TCR (0.7%). To characterize a public TCRα sequence, the inventors compared the length of CDR3 between public and private TCRα sequences and observed that public TCRα had CDR3 with a shorter chain length than private TCRα (median value: 39 vs 42) (FIG. 59).

A TCR shared by a plurality of individuals comprises an invariant TCRα chain at a high frequency.

Public TCRα was observed at a high frequency in PBLs derived from a healthy individual. To determine the origin of public TCRα, the inventors examined the CDR3 sequence of public TCRα that was previous reported. Interestingly, a public TCRα sequence shared by a plurality of individuals comprised invariant TCRα at a high percentage, indicating an iNKT cell or MAIT cell (Table 4-9).

TABLE 4-9

Invariant TCR observed in public TCRα sequence

| Sharing individual[a] | TRAV | TRAJ | CDR3[b] | Germ line like[c] | Invariant TCR[d] |
|---|---|---|---|---|---|
| 16 | TRAV1-2 | TRAJ33 | CAVRDSNYQLIW (SEQ ID NO: 1938) | yes | MAIT |
| 16 | TRAV1-2 | TRAJ33 | CAVMDSNYQLIW (SEQ ID NO: 1939) | | MAIT |
| 15 | TRAV1-2 | TRAJ33 | CAVLDSNYQLIW (SEQ ID NO: 1940) | | MAIT |
| 14 | TRAV1-2 | TRAJ12 | CAVMDSSYKLIF (SEQ ID NO: 1941) | yes | |
| 13 | TRAV1-2 | TRAJ33 | CAVTDSNYQLIW (SEQ ID NO: 1942) | | MAIT |
| 13 | TRAV1-2 | TRAJ20 | CAVRDGDYKLSF (SEQ ID NO: 1943) | yes | |
| 13 | TRAV1-2 | TRAJ33 | CAVKDSNYQLIW (SEQ ID NO: 1944) | | MAIT |
| 11 | TRAV1-2 | TRAJ33 | CAAMDSNYQLIW (SEQ ID NO: 1945) | | MAIT |
| 11 | TRAV1-2 | TRAJ33 | CAALDSNYQLIW (SEQ ID NO: 1946) | | MAIT |
| 10 | TRAV9-2 | TRAJ20 | CALNDYKLSF (SEQ ID NO: 1947) | yes | |
| 10 | TRAV1-2 | TRAJ33 | CAVVSDSNYQLIW (SEQ ID NO: 1948) | | MAIT |
| 10 | TRAV10 | TRAJ18 | CVVSDRGSTLGRLYF (SEQ ID NO: 1949) | yes | iNKT |
| 10 | TRAV1-2 | TRAJ33 | CAVIDSNYQLIW (SEQ ID NO: 1950) | | MAIT |
| 10 | TRAV13-2 | TRAJ9 | CAENTGGFKTIF (SEQ ID NO: 1951) | yes | |
| 9 | TRAV1-2 | TRAJ33 | CAVSDSNYQLIW (SEQ ID NO: 1952) | | MAIT |
| 9 | TRAV9-2 | TRAJ53 | CALSGGSNYKLTF (SEQ ID NO: 1953) | yes | |
| 9 | TRAV2 | TRAJ36 | CAVEDQTGANNLFF (SEQ ID NO: 1954) | | |
| 9 | TRAV9-2 | TRAJ45 | CALSDSGGGADGLIF (SEQ ID NO: 1955) | | |
| 9 | TRAV1-2 | TRAJ20 | CAVRDRDYKLSF (SEQ ID NO: 1956) | | |
| 8 | TRAV1-2 | TRAJ33 | CAGMDSNYQLIW (SEQ ID NO: 1957) | | MAIT |
| 8 | TRAV21 | TRAJ20 | CAVNDYKLSF (SEQ ID NO: 1958) | yes | |
| 8 | TRAV1-2 | TRAJ33 | CAPMDSNYQLIW (SEQ ID NO: 1959) | | MAIT |
| 8 | TRAV1-2 | TRAJ33 | CASMDSNYQLIW (SEQ ID NO: 1960) | | MAIT |
| 7 | TRAV12-2 | TRAJ30 | CAVNRDDKIIF (SEQ ID NO: 1961) | yes | |
| 7 | TRAV13-2 | TRAJ53 | CAENSGGSNYKLTF (SEQ ID NO: 1962) | yes | |
| 7 | TRAV1-2 | TRAJ33 | CAPLDSNYQLIW (SEQ ID NO: 1963) | | MAIT |
| 7 | TRAV9-2 | TRAJ53 | CALNSGGSNYKLTF (SEQ ID NO: 1964) | yes | |
| 7 | TRAV12-1 | TRAJ20 | CVVNDYKLSF (SEQ ID NO: 1965) | yes | |
| 7 | TRAV9-2 | TRAJ20 | CALSSNDYKLSF (SEQ ID NO: 1966) | yes | |
| 7 | TRAV13-1 | TRAJ15 | CAASNQAGTALIF (SEQ ID NO: 1967) | | |
| 7 | TRAV12-1 | TRAJ49 | CVVNTGNQFYF (SEQ ID NO: 1968) | yes | |
| 7 | TRAV12-1 | TRAJ27 | CVVNTNAGKSTF (SEQ ID NO: 1969) | yes | |
| 6 | TRAV2 | TRAJ9 | CAVEDTGGFKTIF (SEQ ID NO: 1970) | | |
| 6 | TRAV1-2 | TRAJ33 | CAVEDSNYQLIW (SEQ ID NO: 1971) | | MAIT |
| 6 | TRAV21 | TRAJ26 | CAVDNYGQNFVF (SEQ ID NO: 1972) | yes | |
| 6 | TRAV9-2 | TRAJ53 | CALSDSGGSNYKLTF (SEQ ID NO: 1973) | | |
| 6 | TRAV21 | TRAJ12 | CAVMDSSYKLIF (SEQ ID NO: 1974) | yes | |
| 6 | TRAV2 | TRAJ9 | CAVNTGGFKTIF (SEQ ID NO: 1975) | yes | |

TABLE 4-9-continued

Invariant TCR observed in public TCRα sequence

| Sharing individual[a] | TRAV | TRAJ | CDR3[b] | Germ line like[c] | Invariant TCR[d] |
|---|---|---|---|---|---|
| 6 | TRAV1-2 | TRAJ33 | CAVR<u>DG</u>NYQLIW (SEQ ID NO: 1976) |  | MAIT |
| 6 | TRAV9-2 | TRAJ8 | CALNTGFQKLVF (SEQ ID NO: 1977) | yes |  |
| 6 | TRAV13-2 | TRAJ44 | CAENTGTASKLTF (SEQ ID NO: 1978) | yes |  |
| 6 | TRAV1-2 | TRAJ33 | CA<u>AT</u>DSNYQLIW (SEQ ID NO: 1979) |  | MAIT |
| 6 | TRAV12-2 | TRAJ15 | CAVNQAGTALIF (SEQ ID NO: 1980) | yes |  |
| 6 | TRAV13-2 | TRAJ42 | CAENYGGSQGNLIF (SEQ ID NO: 1981) | yes |  |
| 6 | TRAV21 | TRAJ30 | CAVL<u>N</u>RDDKIIF (SEQ ID NO: 1982) |  |  |
| 6 | TRAV2 | TRAJ26 | CAVEDNYGQNFVF (SEQ ID NO: 1983) | yes |  |
| 6 | TRAV12-2 | TRAJ20 | CAVNDYKLSF (SEQ ID NO: 1984) | yes |  |
| 6 | TRAV12-1 | TRAJ31 | CVVNNARLMF (SEQ ID NO: 1985) | yes |  |
| 6 | TRAV2 | TRAJ26 | CAV<u>D</u>NYGQNFVF (SEQ ID NO: 1986) | yes |  |
| 6 | TRAV2 | TRAJ3 | CAVDSSASKIIF (SEQ ID NO: 1987) |  |  |
| 6 | TRAV9-2 | TRAJ23 | CALIYNQGGKLIF (SEQ ID NO: 1988) | yes |  |
| 6 | TRAV9-2 | TRAJ9 | CALNTGGFKTIF (SEQ ID NO: 1989) | yes |  |
| 6 | TRAV13-2 | TRAJ39 | CAENNAGNMLTF (SEQ ID NO: 1990) | yes |  |
| 6 | TRAV1-3 | TRAJ12 | CAVL<u>D</u>SSYKLIF (SEQ ID NO: 1991) |  |  |
| 6 | TRAV1-2 | TRAJ12 | CA<u>AM</u>DSSYKLIF (SEQ ID NO: 1992) |  |  |

Non-germ line amino acid sequence was underlined;
[c]CDR3 sequence without a non-germ line sequence is indicated by "yes";
[d]MAIT: Mucosal-associated invariant T cell, iNKT: invariant natural killer T cell It is reported that MAIT cells express TRAV1-2 and TRAJ33, while iNKTs express TRAV10 and TRAJ18. Many public TCRα used TRAV1-2 and TRAJ33 comprising a different CDR3 sequence. The total frequency percentages of MAIT TCRα having TRAV1-2 and TRAJ33 and iNKT TCRα having TRAV10 and TRAJ18 was 0.82±0.72% and 0.15±0.41% per individual, respectively. Among 55 public TCRα sequences, 17 (31%) MAIT and 1 (1.8%) iNKT sequences were observed in 6 or more individuals (FIG. 53). The percentage increased with the number of overlapping individuals. A germ line-like CDR3 sequence without an amino acid sequence modified from a germ line sequence was observed in 27 out of 38 public TCRα (71%) excluding MAIT (TRAV1-2-TRAJ33) and NKT (TRAV10-TRAJ18).

(Discussion)

A high throughput sequencing technique has made a great leap by the development of a wide variety of NGS platforms. Although NGS promotes acquisition of an enormous amount of sequence data, it still requires PCR amplification or gene enrichment of a sequence gene of interest instead of the entire genome or gene library. Multiplex PCR with many gene specific primers have been widely used for non-homogeneous TCR or BCR genes generated by rearrangement of many gene segments. However, amplification bias between each gene occurs from using a plurality of primers to prevent accurate estimation of gene frequency. In this regard, the inventors used adaptor-ligation mediated PCR, which is an unbiased PCR technique, for TCR repertoire analysis based on NGS. This method uses a single set of primers and theoretically enables amplification of all TCR genes without applying PCR bias. Thus, this method is optimal for accurately estimating the amount of each TCR gene present from a wide range of samples.

The inventors comprehensively investigated TCRα and TCR repertoires derived from many individuals (n=20) at a clone level to assess a large amount of sequence data (total of 149216 unique sequence reads from 267037 sequence reads). Thus, the present study elucidated the level of diversity and similarity of a TCR repertoire in a healthy individual and gene use in a normal range. Compared to an Illumina NGS platform (Freeman J D et al. (2009) Genome Res 19: 1817-1824; Warren R L et al. (2011) Genome Res 21: 790-797; Robins H S et al. (2009) Blood 114: 4099-4107), there are not as many sample sequence reads, but the reads are longer and higher quality. The depth of different sequences in a CDR3 contig generated from many shotgun reads by using an Illumina platform can make it difficult to determine a frequency of a TCR clone type. However, it had a long sequence (mean of about 400 bp, Table 4-2 and Table 4-3) that covers all regions of CDR3, V and J and determines all TCR sequences from a single read. Direct analysis from a read sequence that does not use conjugation is highly likely to reflect the actual frequency of a TCR clone type accurately. The error rate in a TCR sequence was slightly lower than a previous report exhibiting a mean error rate of 1.07% for a 454-sequence and a high level of precision and quality was exhibited regardless of nested PCR. Furthermore, RG, the assignment and aggregation software, can quickly aggregate the use of TRV and TRJ and use of recombinations. The integrated analysis facilitates the detection of preferential use of a predetermined TRV and/or TRJ and is thus useful for researching an immune response by an antigen-specific T cell.

Unlike the widely-used multiplex PCR that typically requires compensation for PCR bias (Carlson C S et al. (2013) Nat Commun 4: 2680), AL-PCR accurately estimates a TCR repertoire without bias. A high level of expression of TRBV18 (BV18S1, named by Arden), TRBV19 (BV17S1) and TRBV7-9 (BV6S5) and a low level of expression of TRBV20-1 (BV2S1), TRBV28 (BV3S1), and TRBV29-1 (BV4S1) are reported by multiplex PCR in $CD4^+$ and $CD8^+$ cells (Emerson R et al. (2013) J Immunol Methods 391: 14-21). However, flow cytometry analysis showed that a large amount of TRBV20 and TRBV29 was expressed in PBL (van den Beemd R et al. (2000) Cytometry 40: 336-345; Pilch H et al. (2002) Clin Diagn LabImmunol 9: 257-266; Tzifi F (2013) BMC Immunol 14: 33). The results by the researchers for a TCR repertoire are similar to previous reports (Li S et al. (2013) Nat Commun 4: 2333). Thus, this method provides a direct, accurate, and reliable TCR repertoire result.

Use of recombination showed recombination of AJ-proximal 3' AV segment with AV-distal 3' AJ segment at a low frequency and recombination of AJ-proximal 5' AV segment with AV-distal 5' AJ segment at a low frequency. In gene rearrangement of a TCRαδ gene locus, activation of TCRα enhancer (Eα) and T early alpha (TEA) promoter initiates the first rearrangement of proximal TRAV and TRAJ segments. Subsequent second rearrangement occurs by using 5' proximal TRAV and distal 3' TRAJ genes (Huang C et al. (2001) J Immunol 166: 2597-2601; Krangel M S et al. (2004) Immunol Rev 200:224-232; Pasqual N et al. (2002) J Exp Med 196: 1163-1173; Aude-Garcia C et al. (2001) Immunogenetics 52: 224-230), resulting in restricted use of a TCRα repertoire (continuous bidirectional recombination model) (Chaumeil J et al. (2012) Embo J 31: 1627-1629). However, all TRAV genes can be recombined with a TRAJ gene in the second rearrangement by a gene locus contraction and DNA loop formation model (Genolet R et al. (2012) Embo J 31: 4247-4248). There was inefficient distal-proximal and proximal-distal recombination of TRAV-TRAJ genes, but the use of TRAJ was not limited across all TRAV and was rather equally distributed. This indicates that recombination frequency varies depending on the position of TRAV and is likely dependent on the loop forming ability between a TRAV gene locus and TRAJ gene locus.

Potential TCR diversity generated by addition/deletion of a nucleotide and recombination was estimated to be at most $10^{15}$ (Davis M M et al. (1988) Nature 334: 395-402). The diversity of TCRβ was estimated to be about $3-4\times10^6$ (Robins H S et al. (2009) Blood 114: 4099-4107) or about $1\times10^6$ in humans (Warren R L et al. (2011) Genome Res 21: 790-797) based on NGS. Furthermore, the diversity of TCRα is 50% of TCRβ in humans (Arstila T P et al. (1999) Science 286: 958-961). For mice, TCRα diversity is $0.79\times10^4$ (Pasqual N et al. (2002) J Exp Med 196: 1163-1173) or $1.18\times10^4$ (Cabaniols J P et al. (2001) J Exp Med 194: 1385-1390), indicating that it is 10 times lower than the TCRβ diversity. The low diversity of TCRα may be due to a difference in the recombination process between TCRα and TCRβ. However, the results of the inventors indicated that the level of diversity between TCRα and TCRβ is similar as assessed by the Simpson's index and Shannon-Weaver's index. Similarly, Wang et al have reported that TCR diversity was estimated to be equal between TCRα and TCRβ ($0.47\times10^6$ vs $0.35 \text{ xx}10^6$) (Wang C et al. (2010) Proc Natl Acad Sci USA 107: 1518-1523; Dash P et al. (2011) J Clin Invest 121: 288-295). It is shown that in contrast to the previous report obtained by using a limited number of sequences, for large scale sequencing, the repertoire size for TCRα generated by V-J recombination is comparable to the repertoire size for TCRβ by V-D-J recombination.

Surprisingly, the inventors have found that TCRα repertoires are similar among individuals. This is mainly due to the presence of a TCR sequence shared among 2 or more individuals (public TCR). An addition and deletion of a random nucleotide mediated by terminal deoxynucleotidyl transferase occurs during TCR rearrangement, resulting in significant increase in diversity of a CDR3 region. However, a public TCR appears to have a germ line like CDR3 sequence that does not undergo such an alteration (Table 4-9). Furthermore, a public TCR comprises many TCR clone types having CDR3 with a shorter chain length. The results indicate that high frequency of public TCRα occurs possibly due to a difference in the intrinsic recombination mechanism from TCRβ (V-J vs V-D-J).

It is notable that public TCRα is present in many individuals. The inventors have unexpectedly found that public TCRα comprises invariant TCRα derived from MAIT cells or iNKT cells at a high ratio. These functionally important T cells have homogeneous TCRα and diverse TCRβ. MAIT cells express classical TCRα including TRAV1-2 (Vα7.2)-TRAJ33 (Jα33) and are preferentially located in the intestinal lamina propria (Tilloy F et al. (1999) J Exp Med 189: 1907-1921; Treiner E et al. (2003) Nature 422: 164-169). MAIT cells recognize vitamin B2 metabolites presented by a nonclassical MHC class I molecule, MR1. Furthermore, CD1d-restricted iNKT cells express an invariant TRAV10 (Vα24)-TRAJ18 (Jα18) chain and semi-invariant TRBV25-1 (V1311) (Godfrey D I et al. (2004) Nat Rev Immunol 4: 231-237) and recognize glycolipids such as α-galactosylceramide, self-glycolipid, or isoglobo-trihexosylceramide (Tupin E et al. (2007) Nat Rev Microbiol 5: 405-417). Both cell types play an important role in regulating immune responses to infection, tumor, autoimmune disease and tolerance induction (Godfrey D I et al. (2004) J Clin Invest 114: 1379-1388). The frequency of MAIT cells and iNKT cells obtained in this study is consistent with previous reports (showing that MAIT cells expanded to 1-4% of peripheral blood T cells (Martin E et al. (2009) PLoS Biol 7: e54) and iNKT cells accounted for 0.2% of the entire PBMCs (Lee P T et al. (2002) J Clin Invest 110: 793-800)). Interestingly, there are different types of public sequences having TRAV1-2 (e.g., TRAV1-2-TRAJ12, TRAV1-2-TRAJ20) and some public TCRα sequences other than MAIT and iNKT sequences that are well known. Thus, repertoire analysis based on NGS is useful in both estimating the frequency of MAIT cells or iNKT cells and identifying a potentially new invariant TCRα chain. Further identification and substantiation is required to identify potentially new invariant TCRα.

As discussed above, the inventors have developed a novel TCR repertoire analysis method based on NGS to find the similarity among different individuals between TCRα and TCRβ and comparable diversity therewith from the present Example. A public TCRα sequence comprises functionally significant T cell subpopulation, MAIT and iNKT cells at a high frequency. In addition, an approach to find a public TCR by NGS is useful in identifying a potentially new invariant TCRα chain. This technique with very high precision for TCR repertoire analysis was demonstrated to reveal antigen specific T cells associated with onset of a human disease and contribute to research, diagnosis and therapy of natural and acquired immunity.

Applied Example 1

Example of Antibody Isolation: Example of Isolation of Human Form Antibody Utilizing BCR Repertoire Analysis In this Example, an example of isolating a human form antibody utilizing BCR repertoire analysis is provided as a specific embodiment in actual application.
(Where a Reagent and the Like is Obtained)
Obtaining human form anti-idiotype antibody using humanized NOG mice
1. A monoclonal BCR derived from a tumor cell is observed to be highly expressed in a B cell based leukemia or malignant lymphoma patient.
2. A peripheral blood mononuclear cell is collected from the B cell based leukemia or malignant lymphoma patient to carry out the BCR repertoire analysis described in this section. An immunoglobulin H chain gene derived from a tumor cell is identified, which has the highest ranking and is significantly present from determined genetic sequences of several tens of thousands of reads.
3. The determined immunoglobulin H chain genetic sequence is used to estimate an amino acid sequence of a CDR3 region that is highly diverse, and a peptide that is identical with the sequence is synthesized.
4. 200 μg of synthetic peptide is mixed well with a complete Freund's adjuvant (CFA, Sigma Aldrich) and subcutaneously administered in a humanized NOG mouse with a syringe (first immunization). Similarly, PBS is administered to a control mouse. Furthermore, the same amount of antigen peptide is readministered after 2 weeks from the first immunization.
5. The lymph node or spleen is extracted from the mouse after 4 weeks from the first immunization. Tissue is thinly cut in a phosphate buffered saline (PBS, Invitrogen) and filtered with a cell strainer (0.75 μm, BD) to prepare a single cell.
6. The resulting cell is dissolved in a Trizol solution (Invitrogen). The genetic sequence is determined by the BCR repertoire analysis method described herein.
7. The resulting BCR genetic sequences of several tens of thousands of reads are sorted in the order of the frequency of presence (number of reads) to determine immunoglobulin H chain and L chain genetic sequences having a high ranking. Immunoglobulin H chain and L chain genetic sequences with a significantly high frequency of presence, relative to read ranking of the mouse administered with PBS as a control, are selected.
8. For the resulting immunoglobulin H chain and L chain genetic sequences, a P20EA adaptor primer and a C terminal primer are used for PCR amplification of full length immunoglobulin H chain and full length L chain genes. Each full length gene is inserted into a multi-cloning site in antibody expression vectors pEHX1.1 (for antibody H chain, TOYOBO) and pELX2.2 (for antibody L chain, TOYOBO) with a ligation reaction by using a Ligation Kit (TAKARA). An *E. coli* TOP10 cell line (One Shot™ TOP10 Chemically Competent *E. coli*, Invitrogen) is transformed to obtain an H chain expression plasmid and L chain expression plasmid.
9. Both plasmids are digested twice with BglII and EcoRI restriction enzymes. A BglII-EcoRI fragment of the L chain plasmid is then inserted into a BglII-EcoRI cleavage site of the H chain plasmid to obtain an antibody expressing plasmid that coexpresses the H chain and the L chain.
10. An antibody expressing plasmid is extracted/purified from *E. coli* by using a QIAGEN Plasmid Mini kit and introduced into a CHO cell by using TransIT®-CHO Transfection Kit (TAKARA).
11. The transformed antibody expressing CHO cell line is cultured for expansion. The culture supernatant is collected and purified by using a Protein A agarose affinity column (HiTrap Protein A HP Columns, GE Healthcare) in accordance with the method of application.
12. After measuring the amount of obtained antibody protein with an absorption spectrometer, binding reactivity with an antigen peptide is examined by ELISA.

Ishida I, Tomizuka K, Yoshida H, Tahara T, Takahashi N, Ohguma A, Tanaka S, Umehashi M, Maeda H, Nozaki C, Halk E, Lonberg N. Production of human monoclonal and polyclonal antibodies in TransChromo animals. Cloning Stem Cells. 2002; 4(1): 91-102. Review. can be referred with regard to KM mice used in this Example. Ito M, Hiramatsu H, Kobayashi K, Suzue K, Kawahata M, Hioki K, Ueyama Y, Koyanagi Y, Sugamura K, Tsuji K, Heike T, Nakahata T. NOD/SCID/gamma(c)(null) mouse: an excellent recipient mouse model for engraftment of human cells. Blood. 2002 Nov. 1; 100(9): 3175-82. can be referred with regard to NOG mice. Jayapal K P, Wlaschin K F, Hu W-S, Yap M G S. Recombinant protein therapeutics from CHO cells-20 years and counting. Chem Eng Prog. 2007; 103:40?47; Chusainow J, Yang Y S, Yeo J H, Toh P C, Asvadi P, Wong N S, Yap M G. A study of monoclonal antibody-producing CHO cell lines: what makes a stable high producer? Biotechnol Bioeng. 2009 Mar. 1; 102(4): 1182-96 can be referred with regard to CHO cell/antibody production.

Applied Example 2

Cancer Idiotype Peptide Sensitization Immune Cell Therapeutic Method

Figure 62:
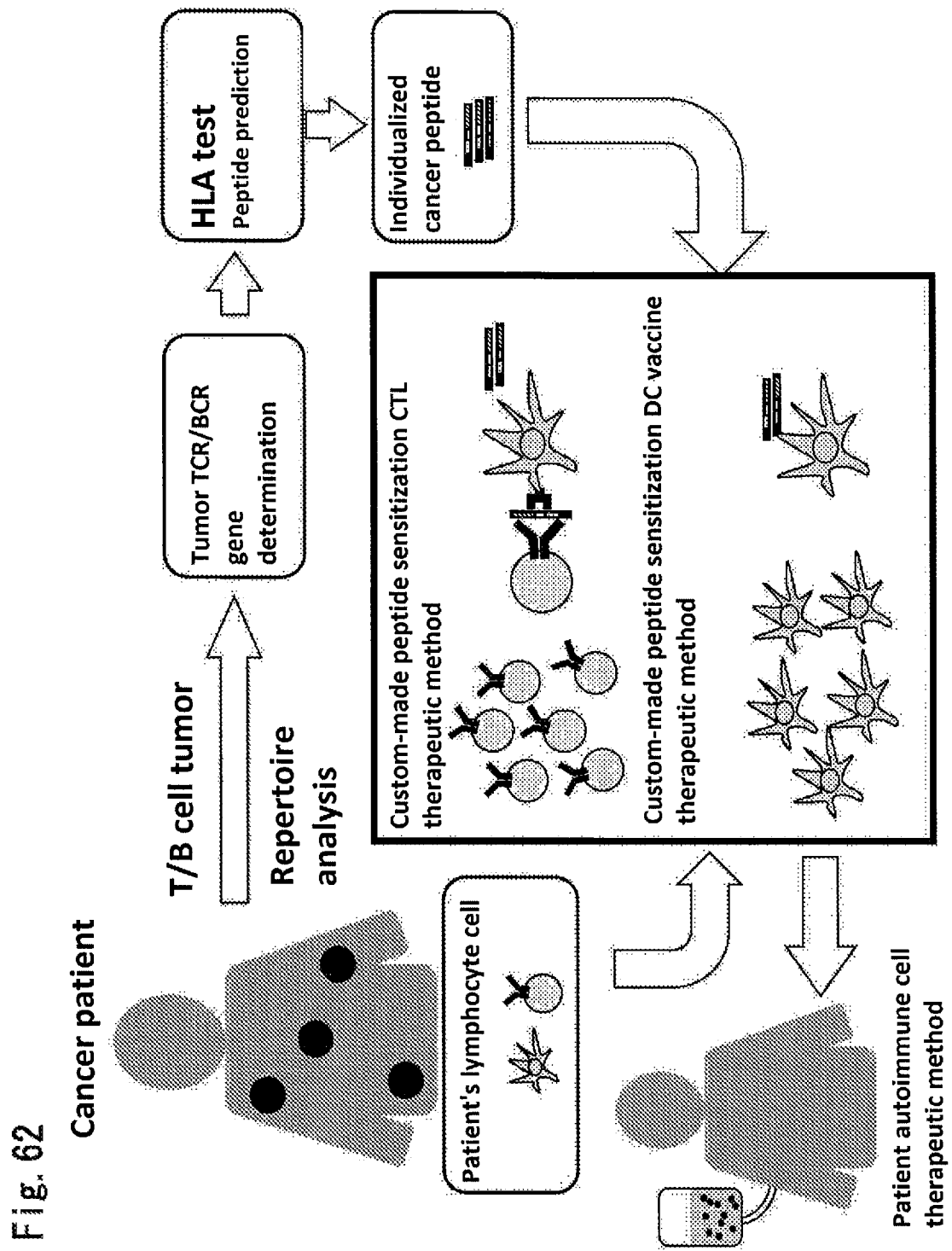
FIG. 62 shows a summary of cancer idiotype peptide sensitization immune cell therapy. Lymphocytes were collected from the patient on the top left and repertoire analysis was conducted for TCRs or BCRs to predict an HLA-binding peptide. The predicted HLA binding peptide is then used for tailor-made peptide sensitization CTL therapeutic method or tailor-made peptide sensitization DC vaccine therapeutic method. Particularly in an antibody therapeutic method targeting a tumor cell, it would be an issue when a target antigen is not expressed in tumor cells or the target antigen is also expressed in normal cells. In comparison, a sequence specific to a tumor cell is selected and utilized herein. Thus, therapy with higher specificity and fewer side effects is expected.

The present Example provides a demonstration of an example for a cancer idiotype peptide sensitization immune cell therapeutic method using the repertoire analysis of the present invention. The procedure thereof is explained below (see FIG. 62).

(1) 10 mL of whole blood is collected from a malignant lymphoma patient. Peripheral blood mononuclear cells (PBMC) are separated by Ficoll-Paque gradient centrifugation (GE Healthcare Bioscience, 17-1440-02)

(2) Total RNA is extracted from the patient PBMCs by using a Trizol Reagent (Invitrogen).

(3) A cDNA is synthesized from RNA with a reverse transcriptase (Superscript II, Invitrogen, 18064-014), and then a dsDNA is synthesized with DNA Polymerase (Invitrogen, 18010-017), *E. coli* Ligase (Invitrogen, 18052-019), and RNase H (Invitrogen, 18021071). Furthermore, the terminal is blunted by T4 DNA Polymerase (Invitrogen, 18005-025). After a ligation reaction of a P20EA/P10EA adaptor with T4 ligase (Invitrogen, 15224-025) (see Preparation Example 2 and the like), the product was digested with NotI (TaKaRa, I 166A).

(4) The $1^{st}$ PCR is carried out by using a P20EA adaptor (SEQ ID NO: 2 and a C region specific primer of IgM of a BCR gene (CM1 (SEQ ID NO: 5)), and the $2^{nd}$ PCR is carried out by using CM2 (SEQ ID NO: 6) and a P20EA primer (SEQ ID NO: 2). 20 cycles of PCR reaction were each performed, where a cycle was 30 seconds at 95° C., 30 seconds at 55° C., and one minute at 72° C.

(5) Column purification is performed with a High Pure PCR Cleanup Micro Kit (Roche) to remove a primer from a $2^{nd}$ PCR amplicon. Subsequently, PCR is performed by using a B-P20EA primer (SEQ ID NO: 4), which is a P20EA primer (SEQ ID NO: 2) added with an adaptor B sequence (SEQ ID NO: 1375), and a GS-PCR primer (see Table 1-1 for sequence information), which is an IgM C region specific primer (CM3) added with an adaptor A sequence (SEQ ID NO: 39) and identification sequence MID Tag sequence (see Table 1-6).

(6) After GS-PCR amplification, 2% agarose gel electrophoresis was carried out. A band was cut out in a size of interest (500 bp-700 bp), when visualized, and purified by using a QIAEX II Gel Extraction Kit (QIAGEN). The amount of the collected DNA was measured by using a Quant-iT™PicoGreen® dsDNA Assay Kit (Invitrogen). 10 million DNAs are used in emulsion PCR for sequence analysis by Roche's next generation sequence analyzer (GS Junior Bench Top system).

(7) A TCR/BCR repertoire analysis software that was newly developed in the present invention (Repertoire Genesis, see Analytical test examples, Analysis Examples 1-5 and the like herein) is used to assign V and J sequences and determine an estimated amino acid sequence of a CDR3 region with the obtained sequence data. At the same time, the number of copies for the same base sequence is counted to provide a ranking by frequency of appearance.

(8) The highest ranking BCR gene is determined. The number of reads of BCR thereof accounting for 10% or more of the total is confirmed to be notably high to identify said BCR gene as a BCR gene derived from tumor.

(9) An HLA binding peptide prediction program BIMAS (www dot bimas dot cit dot nih dot gov/) is used to predict an HLA-binding peptide for an estimated amino acid sequence of the tumor derived BCR gene. The default condition is used unless a particular condition is specified. The BCR amino acid sequence and patient HLA type are input into BIMAS to determine an estimated HLA binding peptide exhibiting the highest score among peptides in a CDR3 amino acid sequence or peptides comprising a part of the CDR3 amino acid sequence.

(10) A cytotoxic T cell (CTL) therapeutic method or dendritic cell (DC) vaccine therapeutic method is carried out by using an HLA-binding peptide with a high score as an individualized cancer peptide. Here, a DC vaccine therapeutic method is implemented.

(11) The individualized cancer peptide sequence is chemically synthesized by using a fully automatic peptide synthesizer (Protein Technologies, Inc.) Peptides with a yield of I mg or greater and purity of 95% or greater are acquired. The peptides are dissolved in 50% DMSO and stored at −20° C.

(12) A blood component collecting apparatus (Terumo apheresis apparatus AC-555) is used to separate monocytes from a cancer patient. After washing cells including the monocytes in an AIM-V medium (Invitrogen, 12055091), the number of cells is counted.

(13) After removing cells that did not adhere to a plastic plate, the cells were cultured for about 1 week in an AIM-V medium comprising 2000 U/mL of granulocyte macrophage colony stimulating factors (GM-CSF, Wako Pure Chemical) and 400 U/mL of interleukin-4 (IL-4, Petrotech) and are induced to differentiate into dendritic cells (DC).

(14) Differentiation into DCs is confirmed by examining expression of MHC class I & II molecules, CD40, CD80 or CD86 by using FACS analysis. $2\times10^6$ cells are then added with 20 µg/mL of individualized cancer peptide and further cultured for a day with stimulating factors (Picibanil (OK-432), Picibanil Injection 0.5KE, Chugai Pharmaceutical) in an AIM-V medium (same as above).

(15) Peptide-stimulated DC cells are collected and washed with saline, and then intravenously injected into the cancer patient by intravenous drip.

(Results)

The following is accomplished by the present Example.

(1) Next generation BCR repertoire analysis on peripheral blood of a malignant lymphoma patient identifies one type of IgM immunoglobulin heavy chain and one type of IgM immunoglobulin light chain accounting for 50% or more of all BCR reads.

(2) A CDR3 region of these immunoglobulin genes is identified by a Repertoire Genesis program.

(3) The patient HLA type (e.g., HLA-A*02) and IgM immunoglobulin heavy chain CDR3 amino acid sequence are input into a BIMAS program. A peptide sequence exhibiting the highest bond score is selected.

(4) This peptide is chemically synthesized as an individualized cancer peptide with a fully automatic peptide synthesizer, and the peptide stimulates and activates DCs from a patient in vitro.

(5) Individualized peptide-stimulated DC cells are intravenously introduced into the patient, whereby reduction in the number of tumor cells and improvement in clinical symptom can be observed.

(Discussion)

It is understood from the present Example that the present invention accomplishes the following effect.

(1) A BCR sequence derived from the patient's cancer cells can be used to make an individualized cancer peptide for therapy. A DC therapeutic method or CTL therapeutic method can be administered to a wide range of patients, regardless of HLA type or antigen expression.

(2) Since a peptide adapted to the HLA of the patient is used, it is possible to materialize an effective DC therapeutic method of CTL therapeutic method that is more adapted to the patient and highly specific to cancer cells.

(3) Since an antigen peptide can be chemically synthesized directly from a genetic sequence obtained from BCR analysis, it is highly safe and requires no antigen identification or the like.

Applied Example 3

Improved CTL Method

Figure 63:
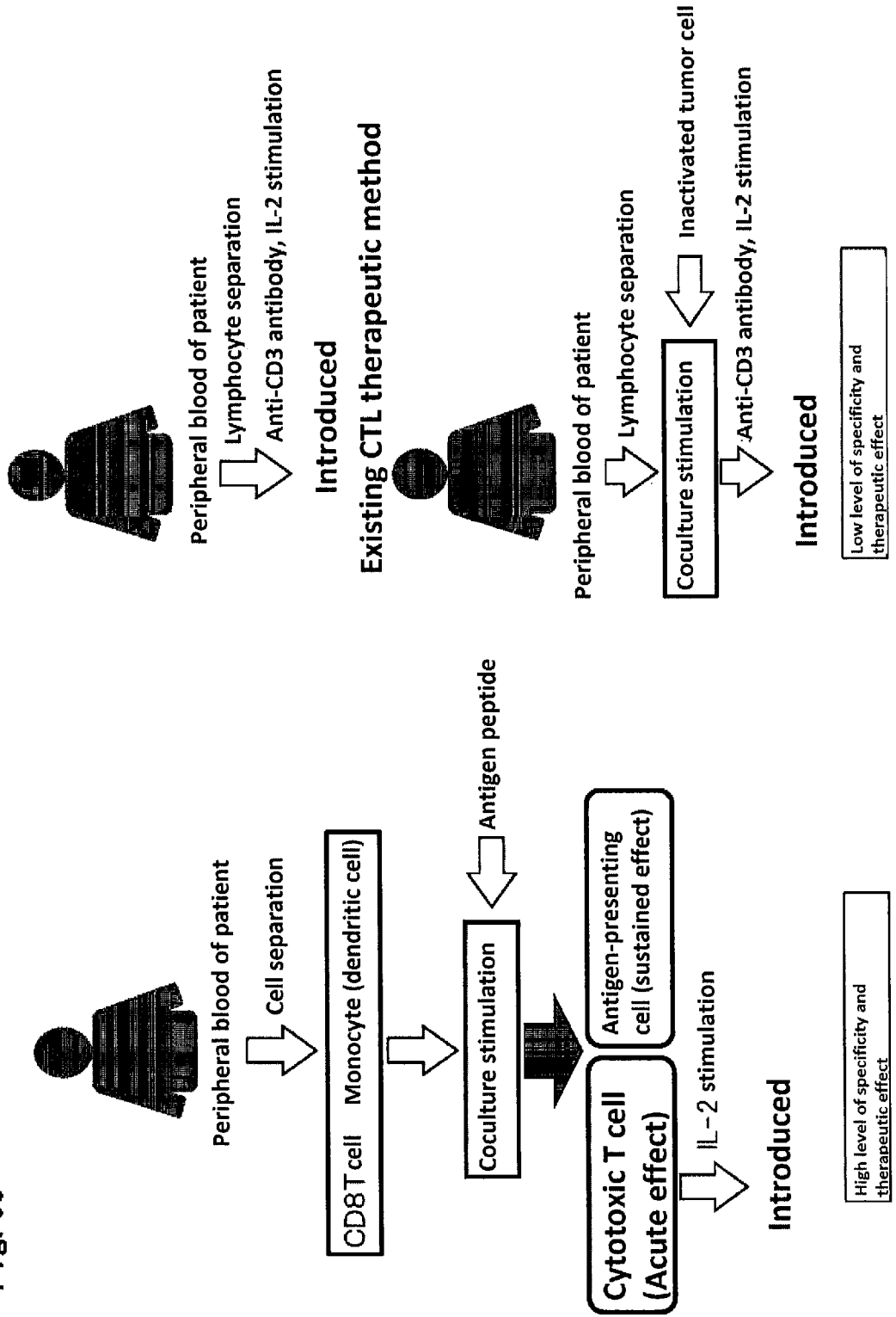
FIG. 63 shows a summary of an improved CTL method. In an existing LAK therapeutic method (top right) or CTL therapeutic method (bottom right), lymphocytes separated from the peripheral blood of a patient are activated by an anti-CD3 antibody and IL-2. On the other hand, an improved CTL therapeutic method (left) separates dendritic cells and $CD8^+$ T cells from the peripheral blood of a patient and uses an antigen peptide for coculture stimulation. Unlike existing activation of a wide range of T cells by an anti-CD3 antibody or IL-2, therapy with higher level of specificity and fewer side effects can be expected by imparting antigen specificity into $CD8^+$ T cells utilizing an antigen peptide. Further, this is characterized in that a high level of therapeutic effect can be expected because an individualized peptide created based on information obtained from a tumor cell of a patient is utilized.

The present Example demonstrates an example with an improved CTL method using repertoire analysis of the present invention. The procedure thereof is explained below (see FIG. 63).

(1) A cancer idiotype peptide is identified by the method of (1)-(9) in Applied Example 2.

(2) An existing cancer peptide (NY-ESO-1 peptide) or a cancer idiotype peptide (peptide identified in (1)) is chemically synthesized by using a fully automatic peptide synthesizer (Protein Technologies, Inc.) Peptides with a yield of 1 mg or greater and purity of 95% or greater are acquired. The peptides are dissolved in 50% DMSO and stored at −20° C.

(3) 20 mL of peripheral blood is collected from the cancer patient. Peripheral blood mononuclear cells (PBMC) are separated by Ficoll-Paque gradient centrifugation (see Applied Example 2).

(4) $CD8^+$ T cells are separated by using a $CD8^+$ T cell separation magnetic bead (Miltenyi Biotech) or flow cytometry apparatus (FACS Aria II, Beckton Dickinson).

(5) Monocytes separated by a blood component collecting apparatus (Terumo apheresis apparatus AC-555) or PBMCs are cultured in a culture plate (100 mm dish, Corning, 353003) and non-adhering cells are removed.

(6) The adhering monocytes are cultured for about 1 week in an AIM-V medium (same as Applied Example 2) comprising 2000 U/mL of granulocyte macrophage colony stimulating factors (GM-CSF, Wako Pure Chemical) and 400 U/mL of interleukin-4 (IL-4, Petrotech) and are induced to differentiate into dendritic cells (DC).

(7) After differentiation into DCs is confirmed, $2 \times 10^6$ cells are added with 20 µg/mL of peptide ("estimated HLA binding peptide exhibiting the highest score" in Applied Example 2) and further cultured for a day with stimulating factors (Picibanil (OK-432), Picibanil Injection 0.5KE, Chugai Pharmaceutical) in an AIM-V medium.

(8) Furthermore, the DC culture solution is stimulated and cultured with 20 µg/mL of synthetic peptide ("estimated HLA binding peptide exhibiting the highest score" in Applied Example 2) and $2 \times 10^6$/mL of CD8$^+$ T cells separated in the above-described (3) and AIM-V medium (see Applied Example 2 and the like).

(9) After CD8+ T cells proliferated by antigen stimulation are separated from DCs adhering to a plastic culture plate (100 mm dish, Corning, 353003) (same as the plate in (5)), the cells are expanded and cultured in the presence of 5 µg/mL of antiCD3 antibody (OKT3, Orthoclone OKT3, Janssen Pharmaceutical) and 200 U/mL of interleukin 2 (IL-2) (Roche Applied Science, 10799068001).

(9) After the activated CD8+ T cells are collected as CTL cells and washed with saline, they are intravenously injected into the cancer patient by intravenous drip.

(Results)

The present Example accomplishes the following.

(1) An HLA binding peptide is identified from a CDR3 region of a BCR gene derived from a tumor cell of a malignant lymphoma patient.

(2) $2 \times 10^6$ CD8 positive cells were collected from the peripheral blood of the patient with a CD8+ T cell separation magnetic bead. The purity is 98%.

(3) Antigen stimulation is applied in mixed culture of a peptide, CD8+ cell, and DC cell derived from monocytes of the patient. Furthermore, CD8+CTL cells can proliferate up to 50 fold in expansion and culture in the presence of anti-CD3 antibodies and IL-2.

(4) The cultured CTL cells are intravenously introduced into the patient, whereby reduction in the number of tumor cells and improvement in clinical symptom can be observed.

(Discussion)

It is understood from the present Example that the present invention accomplishes the following effect.

(1) A BCR sequence derived from the patient's cancer cells can be used to make an individualized cancer peptide for therapy. A CTL therapeutic method can be administered to a wide range of patients, regardless of HLA type or antigen expression.

(2) Since a peptide adapted to the HLA of the patient is used, it is possible to materialize an effective CTL therapeutic method that is more adapted to the patient and highly specific to cancer cells.

(3) Since an antigen peptide can be chemically synthesized directly from a genetic sequence obtained from BCR analysis, it is highly safe and requires no antigen identification or the like.

Applied Example 4

DC Vaccine Therapeutic Method

Figure 64:
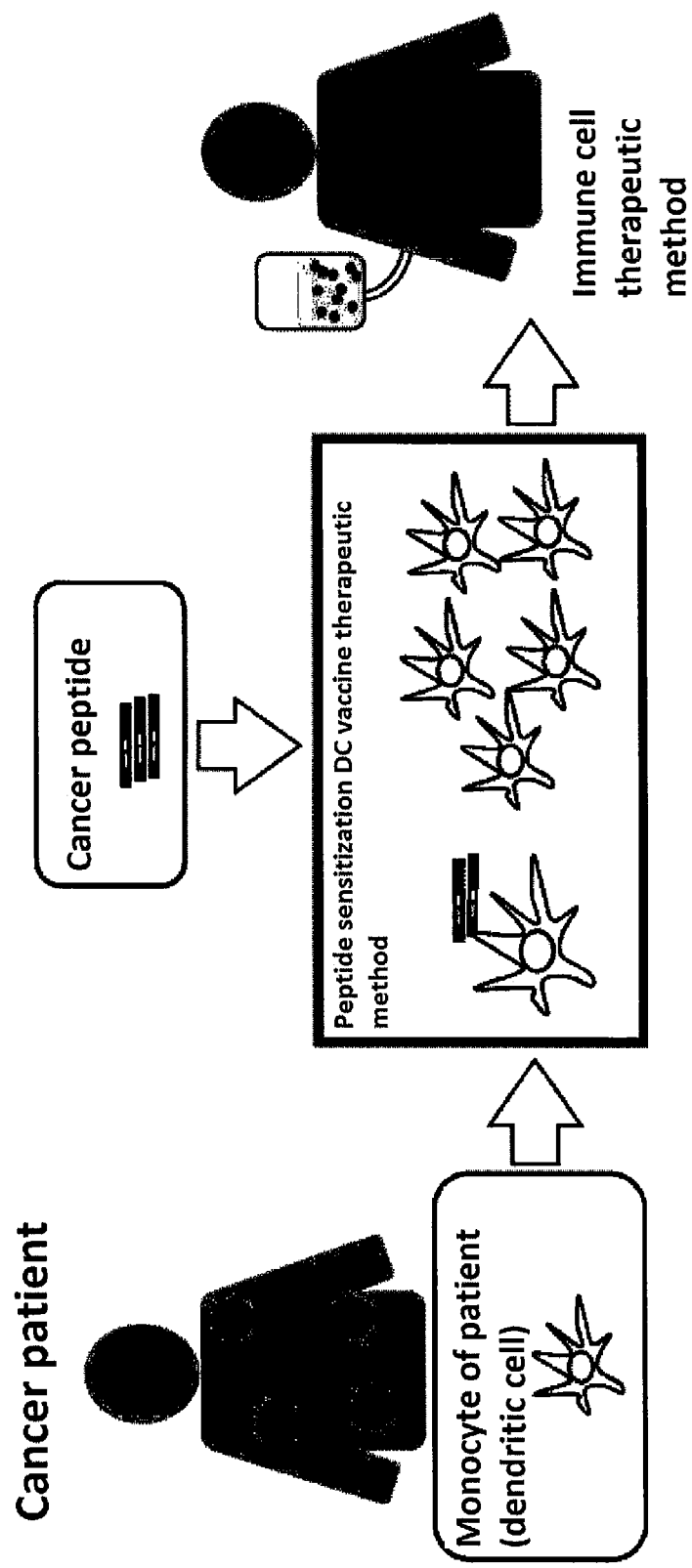
FIG. 64 shows a summary of a DC vaccine therapeutic method. A dendritic cell is separated from the patient on the left and is mixed and cultured with an antigen peptide. In a DC vaccine therapeutic method, an individualized peptide is created based on sequence information obtained from a tumor cell derived from a patient. Thus, the therapeutic method does not act on normal cells while act on tumor cells more specifically, such that a high therapeutic effect can be expected. Since a peptide is used as an antigen, unlike proteins, there is an advantage of being able to readily chemically synthesize.

The present Example demonstrates an example of a DC vaccine therapeutic method using repertoire analysis of the present invention. The procedure thereof is explained below (see FIG. 64).

(1) A cancer idiotype peptide is identified by the method of (1)-(9) in Applied Example 2.

(2) An existing cancer peptide (NY-ESO-1 peptide) or a cancer idiotype peptide (peptide identified in (1)) is chemically synthesized by using a fully automatic peptide synthesizer (Protein Technologies, Inc.) Peptides with a yield of 1 mg or greater and purity of 95% or greater are acquired. The peptides are dissolved in 50% DMSO and stored at −20° C. Monocytes are separated by component collection (apheresis) from a cancer patient.

(3) Monocytes are separated by a blood component collecting apparatus (Terumo apheresis apparatus AC-555) from the patient. Cells including monocytes are washed in an AIM-V medium (see Applied Example 2 and the like), and the number of cells was counted.

(4) After removing cells that did not adhere to a plastic plate (100 mm dish, Corning, 353003), the cells were cultured for about 1 week in an AIM-V medium (see Applied Example 2) comprising 2000 U/mL of granulocyte macrophage colony stimulating factors (GM-CSF, Wako Pure Chemical) and 400 U/mL of interleukin-4 (IL-4, Petrotech) and are induced to differentiate into dendritic cells (DC).

(5) Differentiation into DCs is confirmed by examining expression of MHC class I & II molecules, CD40, CD80 or CD86 by using FACS. $2 \times 10^6$ cells are added with 20 µg/mL of peptide (peptide synthesized in (2)) and further cultured for a day with stimulating factors (Picibanil (OK-432), Picibanil Injection 0.5KE, Chugai Pharmaceutical) in an AIM-V medium (see Applied Example 2 and the like).

(6) Peptide-stimulated DC cells are collected and washed with saline, and then intravenously injected (Terufusion Infusion System, Terumo) into the cancer patient by intravenous drip.

(Results)

The present Example accomplishes the following.

(1) An HLA binding peptide is identified from a CDR3 region of a BCR gene derived from a tumor cell of a malignant lymphoma patient.

(2) Monocytes are separated from the peripheral blood of the patient and cultured in a differentiation culture medium to detect MHC DR+, CD40+, or CD80/CD86+ cells for confirming differentiation from monocytes to DCs.

(3) The peptide-stimulated DC cells are intravenously introduced into the patient, whereby reduction in the number of tumor cells and improvement in clinical symptom can be observed.

(Discussion)

It is understood from the present Example that the present invention accomplishes the following effect.

(1) A BCR sequence derived from the patient's cancer cells can be used to make an individualized cancer peptide for therapy. A DC therapeutic method can be administered to a wide range of patients, regardless of HLA type or antigen expression.

(2) Since a peptide adapted to the HLA of the patient is used, it is possible to materialize an effective DC therapeutic method that is more adapted to the patient and highly specific to cancer cells.

(3) Since an antigen peptide can be chemically synthesized directly from a genetic sequence obtained from BCR analysis, it is highly safe and requires no antigen identification or the like.

Applied Example 5

Patient Autoimmune Cell Therapeutic Method

Figure 65:
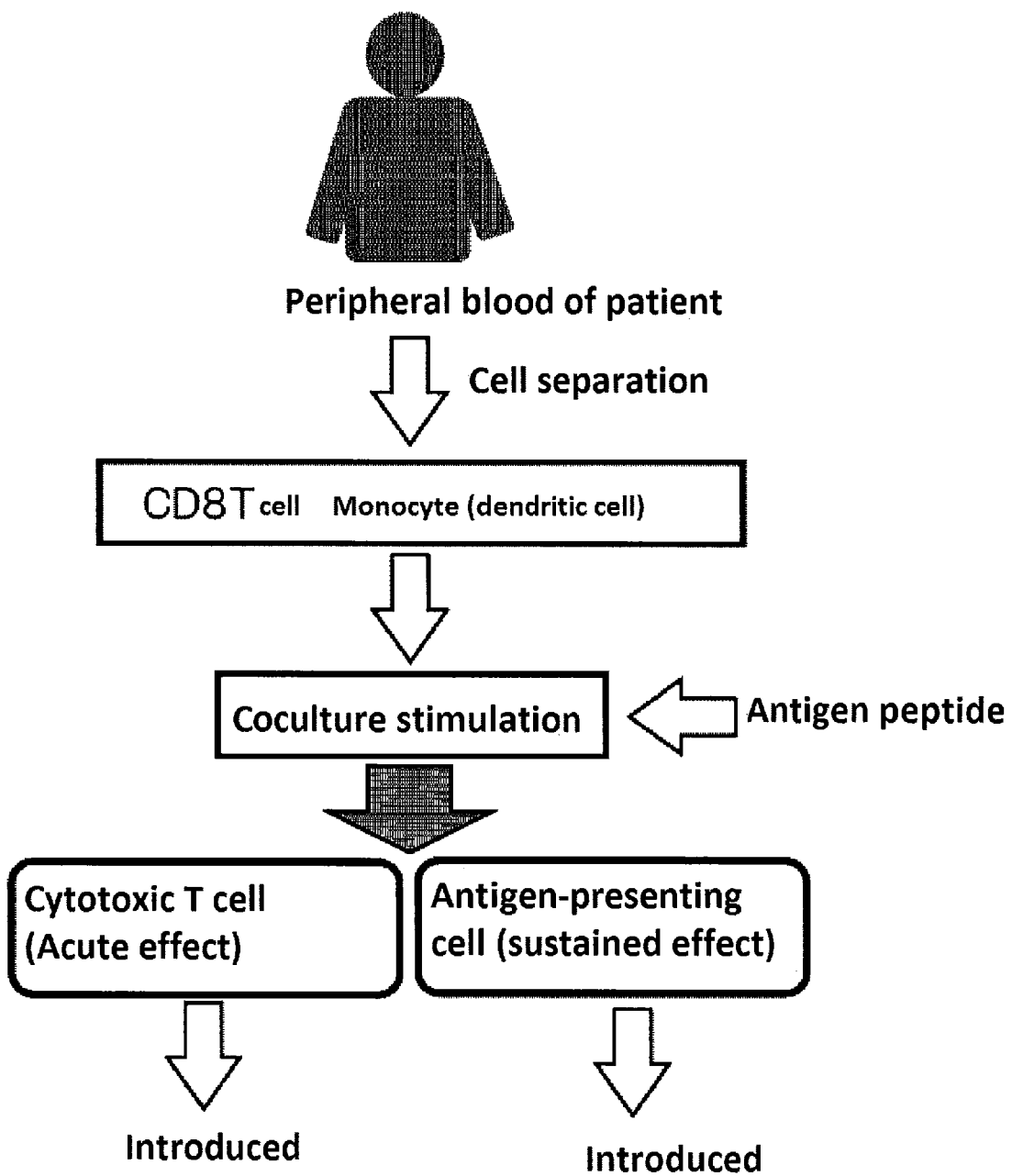
FIG. 65 shows a summary of a patient autoimmune cell therapeutic method. An improved CTL therapeutic method (left) separates dendritic cells and CD8$^+$ T cells from the peripheral blood of a patient and uses an antigen peptide for coculture stimulation. Both cytotoxic T cells and antigen presenting cells are introduced into the patient. Thus, this is characterized in having expectation of a synergistic effect which is between an acute effect due to CTL imparting specificity and a sustained effect due to dendritic cells utilized as an antigen-presenting cell.

The present Example demonstrates an example of a patient autoimmune cell therapeutic method using repertoire analysis of the present invention. The procedure thereof is explained below (see FIG. 65).
(1) A cancer idiotype peptide is identified by the method of (1)-(9) in Applied Example 2.
(2) An existing cancer peptide or a cancer idiotype peptide (peptide identified in (1)) is chemically synthesized by using a fully automatic peptide synthesizer (Protein Technologies, Inc.) Peptides with a yield of 1 mg or greater and purity of 95% or greater are acquired. The peptides are dissolved in 50% DMSO and stored at −20° C.
(3) 20 mL of peripheral blood is collected from a cancer patient. Peripheral blood mononuclear cells (PBMC) are separated by Ficoll-Paque gradient centrifugation.
(4) CD8+ T cells are separated by using a CD8+ T cell separation magnetic bead (Miltenyi Biotech) or flow cytometry apparatus (FACS Aria II, Beckton Dickinson).
(5) Monocytes separated by a blood component collecting apparatus (Terumo apheresis apparatus AC-555) or PBMCs are cultured in a culture plate (100 mm dish, Corning, 353003) and non-adhering cells are removed.
(6) The adhering monocytes are cultured for about 1 week in an AIM-V medium (same as Applied Example 2) comprising 2000 U/mL of granulocyte macrophage colony stimulating factors (GM-CSF, Wako Pure Chemical) and 400 U/mL of interleukin-4 (IL-4, Petrotech) and are induced to differentiate into dendritic cells (DC).
(7) After differentiation into DCs is confirmed, $2 \times 10^6$ cells are added with 20 µg/mL of peptide (peptide synthesized in (2)) and further cultured for a day with stimulating factors in an AIM-V medium.
(8) Furthermore, the DC culture solution is stimulated and cultured with 20 µg/mL of synthetic peptide (peptide synthesized in (2)) and $2 \times 10^6$/mL of CD8+ T cells isolated in the above-described (3) and AIM-V medium (same as Applied Example 2 and the like).
(9) After the activated CD8+ T cells are collected with peptide-stimulated DC cells and washed with saline, they are intravenously injected into the cancer patient by intravenous drip.

(Results)

The present Example accomplishes the following.
(1) An HLA binding peptide is identified from a CDR3 region of a BCR gene derived from a tumor cell of a malignant lymphoma patient.
(2) $2 \times 10^6$ CD8 positive cells were collected from the peripheral blood of the patient with a CD8+ T cell separation magnetic bead. The purity is 98% or higher.
(3) Monocytes are separated from the peripheral blood of the patient and cultured in a differentiation culture medium to confirm differentiation into DCs, MHC DR+, CD40+, or CD80/CD86+.
(4) Tumor-specific CTLs and DCs can proliferate by a mixed culture of a peptide, CD8+ cell, and DC derived from the patient's monocyte.
(5) Peptide-stimulated CD8+ cells and DC cells are both intravenously introduced into the patient, whereby reduction in the number of tumor cells and improvement in clinical symptom can be observed.

(Discussion)

It is understood from the present Example that the present invention accomplishes the following effect.
(1) A BCR sequence derived from the patient's cancer cells can be used to make an individualized cancer peptide for therapy. A patient autoimmune cell therapeutic method can be administered to a wide range of patients, regardless of HLA type or antigen expression.
(2) Since a peptide adapted to the HLA of the patient is used, it is possible to materialize an effective patient autoimmune cell therapeutic method that is more adapted to the patient and highly specific to cancer cells.
(3) Since an antigen peptide can be chemically synthesized directly from a genetic sequence obtained from BCR analysis, it is highly safe and requires no antigen identification or the like.
(4) A synergistic effect of DC cells and CTL cells can be expected, and a high therapeutic effect is anticipated.

Applied Example 6

Figure 66:
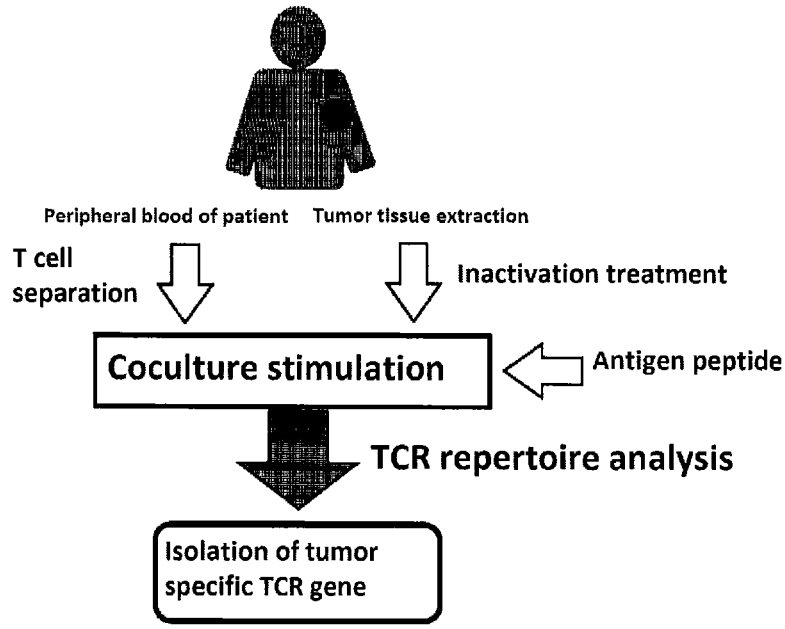
FIG. 66 shows a summary for the isolation of a tailor-made cancer specific T cell receptor gene and isolation of a cancer specific TCR gene by an in vitro antigen stimulation. As shown, a tumor specific TCR gene is obtained by coculturing T cells derived from a patient, inactivated cancer derived from a patient and an antigen peptide. Once genetic information is obtained, a cancer specific TCR gene that is isolated by an in vitro antigen stimulation can be prepared by using any well-known technology in the art. Such an isolated tailor-made cancer specific T cell receptor gene and cancer specific TCR gene can be used for therapy and prevention of various cancers.

Isolation of Tailor-Made Cancer Specific T Cell Receptor Gene, Isolation of Cancer Specific TCR Gene by In Vitro Antigen Stimulation The present Example demonstrates an example of isolation of a tailor-made cancer specific T cell receptor gene and isolation of a cancer specific TCR gene by in vitro antigen stimulation using repertoire analysis of the present invention. The procedure thereof is explained below (see FIG. 66).
(1) Tumor cells are extracted from a cancer patient by a conventional method.
(2) After finely cutting the tumor cell derived from the patient in a culture medium (RPMI 1640, 11875-093, Invitrogen, hereinafter also referred to as "culture solution") and filtering with a 0.70 µm filter (Falcon cell strainer, Corning), cells are separated into single cells and inactivated with 10 µg/ml of mitomycin C (Mitomycin C for injection, Kyowa Hakko Kirin)) for 2 hours at 37° C. in the culture solution.
(3) Peripheral blood mononuclear cells (PBMC) are separated from 10 mL of whole blood of the cancer patient by Ficoll-Paque gradient centrifugation. The PBMCs are washed and then suspended in a culture medium (RPMI 1640) at a concentration of $2 \times 10^6$/mL.
(4) An RNA is extracted by a Trizol RNA extraction kit (Invitrogen) with some ($1 \times 10^6$) of the PBMCs as an untreated control sample.
(5) Inactivated tumor cells and the peripheral blood cells are cultured for one week in an RPMI 1640 medium (RPMI 1640, 11875-093, Invitrogen) comprising 10% FCS (16000-044, Invitrogen) in the presence of a low concentration of IL-2 to stimulate and grow tumor specific T cells with an antigen.
(6) After activation of the T cells, live cells are collected from the culture medium and washed with PBS (045-29795, Wako Pure Chemical), and an RNA is extracted from the cells.
(7) The repertoire analysis method of the present invention is implemented by using the RNA samples extracted in (4) and (6) (for the condition thereof, the condition described in Analytical test examples and Analysis Examples 1-5 herein can be used).

(8) From the TCR genetic sequence data obtained by the next generation repertoire analysis of the present invention, a TCR gene that has greatly increased with a stimulation sample relative to a control sample is extracted and ranked, and then high ranking TCRα and TCRβ genes are selected;
(9) Each of the full-length TCRα and TCRβ genes are cloned and introduced into a retroviral vector for gene expression (Retro-X Vectors and Systems, Clonetech).
(10) A gene introducing retrovirus is created from transformation of a packaging cell GP2-293 cell line (631458, Clonetech) by using the TCRα and TCRβ recombinant plasmid vectors prepared in (9).
(11) Lymphocyte cells separated by a blood component collecting apparatus (Terumo apheresis apparatus AC-555) are used to independently and successively infect gene recombinant TCRα and TCRβ retroviruses to obtain a population of lymphocytes expressing a functional αβ TCR.
(12) Expression of TCRα/TCRβ heterodimers on a cell surface and the percentage of positive cells thereof are confirmed by FACS (see Applied Example 5, the same condition can be used).
(13) A tumor specific patient lymphocyte expressing TCRα/TCRβ of interest is introduced into the cells of the patient.

(Results)

The present Example accomplishes the following.
(1) When a TCR gene that increases in tumor tissue is selected and ranked from comparing a sample stimulated in the tumor tissue of a patient with a control sample, TCRs that are present in a large number in peripheral blood cells are excluded. Thus, numerous tumor specific TCR genes are extracted.
(2) TCRα and TCRβ genes at about the same level of ranking are selected from the extracted genes and utilized in making lymphocytes introduced with a tumor specific TCR gene.
(3) Full length TCRα and β chain genes can be cloned in a retrovirus expression vector. A TCRα retrovirus and TCR retrovirus with a high titer can be made by packaging.
(4) The patient lymphocyte is infected with a mixed retrovirus to verify expression of recombinant TCRα/TCRβ by FACS.
(5) Tumor specific TCR gene recombinant lymphocytes manufactured by the series of steps are introduced into the patient, whereby reduction in the number of tumor cells and improvement in clinical symptom can be observed.

(Discussion)

It is understood from the present Example that the present invention accomplishes the following effect.
(1) Patient's own cancer cell and T cell can be used to make a therapeutic lymphocyte introduced with a tumor specific TCR gene. TCR gene therapy can be administered to a wide range of patients, regardless of HLA type or antigen expression.
(2) Since a TCR sequence present in a patient sample is utilized, it is possible to utilize a TCR gene matching the HLA of the patient and materialize an effective therapy that is highly specific to cancer cells.
(3) Since a TCR sequence present in a patient sample is utilized, it is possible to materialize highly safe TCR gene therapy that does not react with normal cells of the patient.
(3) Since a genetic sequence obtained from TCR analysis is directly utilized, there is no need for identifying an antigen or obtaining a TCR gene using a specific antigen.

Applied Example 7

Figure 67:
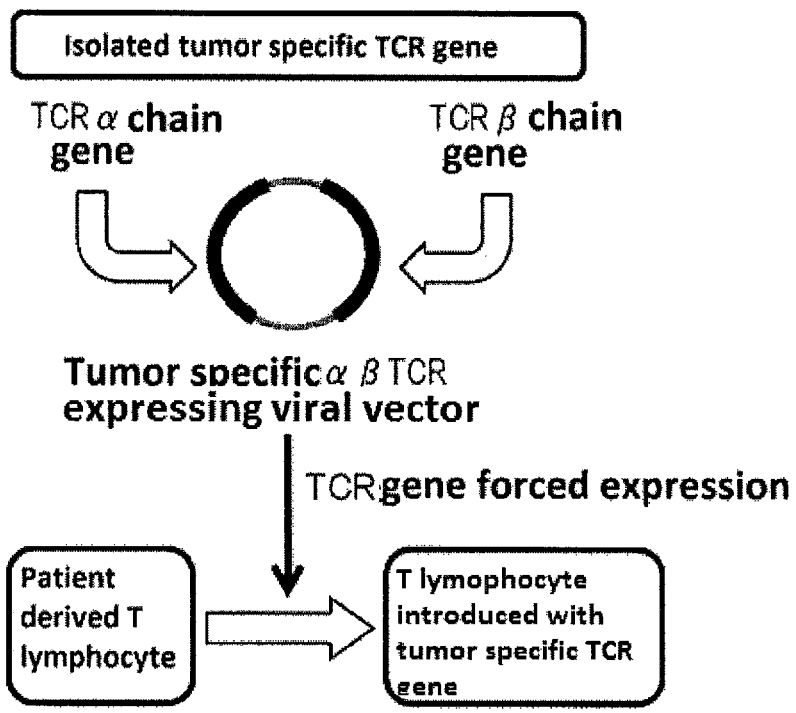
FIG. 67 shows a summary for preparation of an isolated cancer specific TCR gene by an in vitro antigen stimulation. As shown, obtained TCRα and TCRβ genes are introduced into a TCR expressing viral vector (middle) to infect a T lymphocyte from a patient for transformation.

Preparation of Isolated Cancer Specific TCR Gene by In Vitro Antigen Stimulation The present Example demonstrates an example of preparation of an isolated cancer specific TCR gene by in vitro antigen stimulation using repertoire analysis of the present invention. The procedure thereof is explained below (see FIG. 67).
(1) Tumor cells are extracted and peripheral blood is simultaneously separated from each of the cancer patients with the same HLA.
(2) An RNA is extracted by using a Trizol Reagent (Invitrogen) from a lymphocyte cell or tumor tissue comprising tumor cell infiltrated T cell.
(3) A TCR gene (same as the Preparation Examples and the like) is amplified by Adaptor-ligation PCR explained in the Preparation Examples and the like herein from the RNA to perform repertoire analysis by next generation sequencing with a GS Junior Bench Top system (Roche) or the like.
(4) A newly developed TCR/BCR repertoire analysis software (Repertoire Genesis, see Analysis Examples 1-5 herein) is used on the TCR genetic sequences obtained by the use thereof to determine sequences of V, D, and CDR3 regions and to create a ranking based on the frequency of presence of the same sequence.
(5) A TCR gene exhibiting a high frequency of presence in a tumor cell relative to a peripheral cell in each patient (a specific example herein is those with frequency of presence >10-fold and high ranking in tumor tissue) is searched to identify the gene as tumor specific.
(6) A TCR genetic sequence shared among a plurality of cancer patients having the same HLA is searched for such tumor specific TCR genes.
(7) A tumor specific TCR gene shared among the most cancer patients is selected as a tumor specific TCR for therapy.
(8) The full length TCRα and TCRβ genes are cloned and introduced into a retroviral vector for gene expression (the same one as in Applied Example 6 can be used).
(9) A gene introducing virus is created from the TCRα and TCRβ gene expression retroviral vector in accordance with the method of (10) in the above-described Applied Example 6.
(10) Lymphocytes collected from the patient are mixed with a culture solution containing the TCRα retrovirus made by the above-described (9) and culture solution containing a TCRβ retrovirus in equal amounts and cultured for 4 hours at 37° C. The cells are then washed with PBS and further cultured for 24 hours at 37° C.
(11) Expression of a genetically recombinant TCRαβ molecule on a cell surface is verified. The percentage of TCRβ chain positive cells to undergo transgenesis in CD8 positive cells is verified by FACS analysis using antihuman CD8 antibodies (CD8α, 6602385, Beckman Courter) and an IOTest Beta Mark TCR Vβ repertoire analysis kit (Multi-analysis TCR Vβ antibodies, IM3497, Beckman Courter).
(12) A cell with confirmed expression of TCRαβ of interest in (11) is cultured in an RPMI 1640 medium under the condition of 37° C. at a concentration of $0.5 \times 10^6$ cells. After washing lymphocytes introduced with a tumor specific TCR gene with PBS, cells are introduced into the cancer patient by intravenously injection by intravenous drip (Terufusion Infusion System, Terumo).

(Results)

The present Example accomplishes the following.

(1) When a TCR gene shared among tumor tissues of patients is selected and ranked, TCRs that are present in a large number in peripheral blood cells are excluded. Thus, numerous tumor specific TCR genes are extracted.

(2) A pair of TCRα and TCRβ genes at about the same level of ranking and present in the same patient is selected from the extracted genes and utilized in making lymphocytes introduced with a tumor specific TCR gene.

(3) Full length TCRα and β chain genes can be cloned in a retrovirus expression vector. A TCRα retrovirus and TCRβ retrovirus with a high titer can be made by packaging.

(4) The patient lymphocyte is infected with a mixed retrovirus to verify expression of recombinant TCRα/TCRβ by FACS.

(5) Tumor specific TCR gene recombinant lymphocytes manufactured by the series of steps are introduced into the patient, whereby reduction in the number of tumor cells and improvement in clinical symptom can be observed.

(Discussion)

It is understood from the present Example that the present invention accomplishes the following effect.

(1) Patient's own cancer cell and T cell can be used to make a therapeutic lymphocyte introduced with a tumor specific TCR gene. TCR gene therapy can be administered to a wide range of patients, regardless of HLA type or antigen expression.

(2) Since a TCR sequence present in a patient sample is utilized, it is possible to utilize a TCR gene matching the HLA of the patient and materialize an effective therapy that is highly specific to cancer cells.

(3) Since a TCR sequence present in a patient sample is utilized, it is possible to materialize highly safe TCR gene therapy that does not react with normal cells of the patient.

(3) Since a genetic sequence obtained from TCR analysis is directly utilized, there is no need for identifying an antigen or obtaining a TCR gene using a specific antigen.

Applied Example 8

Cell Processing Therapeutic Method

Figure 68:
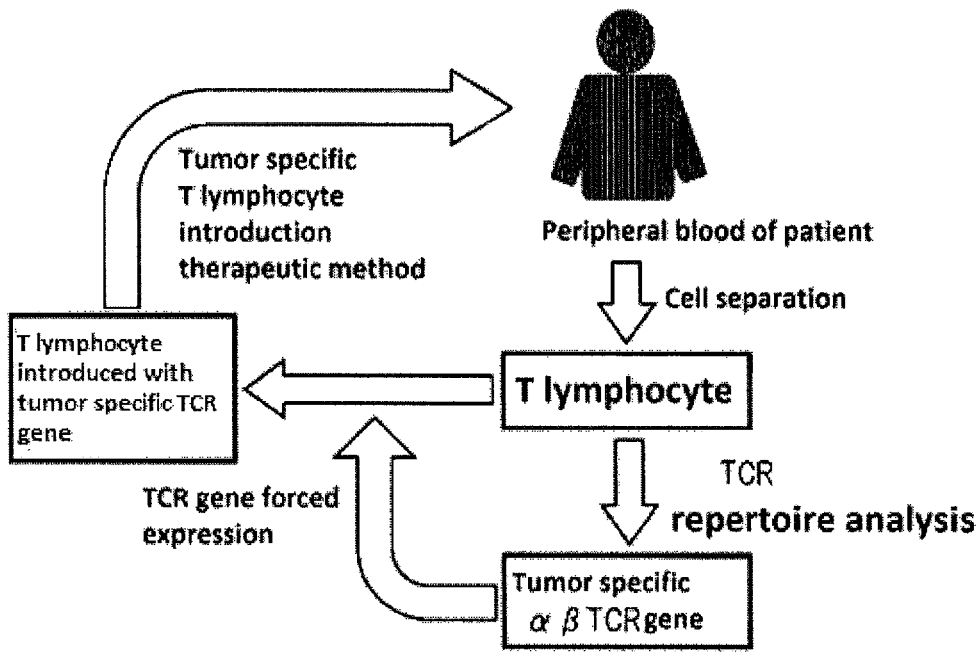
FIG. 68 shows a summary of a cell processing therapeutic method. As shown, a tumor specific TCR gene obtained by TCR repertoire analysis from T lymphocytes isolated from the patient on the top right is introduced into a T lymphocyte derived from a patient to introduce a tumor specific T lymphocyte into the patient. Optimal TCR candidates can be artificially transgenically introduced into a lymphocyte of the patient to select a TCR exhibiting the highest reactivity to actual cancer tissue of the patient as the optimal TCR.

The present Example demonstrates an example of a cell processing therapeutic method using repertoire analysis of the present invention. The procedure thereof is explained below (see FIG. 68).

(1) A retrovirus for transgenesis is made in accordance with Applied Example 6 to create a lymphocyte population expressing functional αβ TCRs.

(2) A tumor cell derived from a patient that has been separated and inactivated in accordance with the procedures of Applied Example 6 (1)-(2) is diluted with an RPMI 1640 medium (11875-093, Invitrogen).

(3) The lymphocyte introduced with a tumor specific TCR genes made in (1) and inactivated tumor cells of the patient were mixed at a cell concentration of $1 \times 10^6$/mL at a lymphocyte-tumor cell ratio (E:T ratio) of 2:1, 1:1, and 0.5:1 and cultured for 24 hours at 37° C. by using an ELISPOT kit (IFN-γ, Human, ELISpot Kit, EL285, R&D Systems).

(4) After 24 hours, the cells are removed. Production of INFγ on a PVFD membrane is detected by a coloring method, and the number of IFNγ producing cells is counted to assess the tumor specificity of lymphocytes introduced with tumor specific TCR genes.

(5) When IFNγ production is not observed in 5% of cells or less, a pair is selected with a high ranking and exhibiting a ratio of presence of TCRα and TCRβ at about the same level among TCR genes other than TCRs employed in (8) of Applied Example 6. After going through steps (9)-(11) in Applied Example 6, a new lymphocyte introduced with a tumor specific TCR gene is made.

(6) The above-described steps (1)-(4) are carried out for the TCRα and TCRβ to assess tumor specificity of lymphocytes introduced with a tumor specific TCR gene.

(Results)

The present Example accomplishes the following.

(1) A lymphocyte introduced with a tumor specific TCR gene is made to examine the reactivity to inactivated tumor cells. It can be understood that the lymphocyte introduced with a TCR gene produces IFNγ in response to tumor.

(2) The lymphocyte introduced with a tumor specific TCR gene is introduced into a patient, and an antitumor effect and improvement in clinical symptom are observed.

(Discussion)

It is understood from the present Example that the present invention accomplishes the following effect.

(1) Patient's own cancer cell and T cell can be used to make a therapeutic lymphocyte introduced with a tumor specific TCR gene. TCR gene therapy can be administered to a wide range of patients, regardless of HLA type or antigen expression.

(2) Since a TCR sequence present in a patient sample is utilized, it is possible to utilize a TCR gene matching the HLA of the patient and materialize an effective therapy that is highly specific to cancer cells.

(3) Since a TCR sequence present in a patient sample is utilized, it is possible to materialize highly safe TCR gene therapy that does not react with normal cells of the patient.

(3) Since a genetic sequence obtained from TCR analysis is directly utilized, there is no need for identifying an antigen or obtaining a TCR gene using a specific antigen.

Applied Example 9

Method of Assessing Efficacy and/or Safety by In Vitro Stimulation Test

Figure 69:
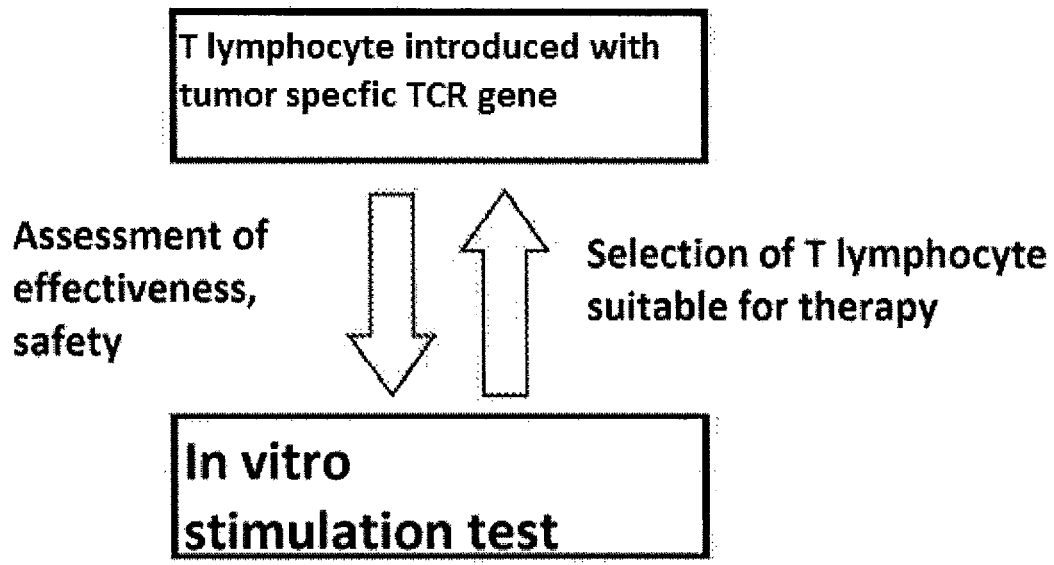
FIG. 69 shows a summary for a method of performing an in vitro stimulation test to assess efficacy and/or safety. The efficacy and/or safety of a T lymphocyte introduced with a tumor specific TCR is assessed by an in vitro stimulation test (arrow pointing down). A T lymphocyte suitable for therapy is selected based on such assessment in vitro (arrow pointing up). Efficacy is assessed by coculturing a lymphocyte introduced with a tumor specific TCR and a cancer cell derived from a patient and testing the reactivity. When safety is assessed, the same test is performed by using normal cells instead of cancer cells.

The present Example provides an example demonstrating assessment of efficacy and/or safety by in vitro stimulation test using repertoire analysis of the present invention. The procedure thereof is explained below (see FIG. 69).

(1) A retrovirus for transgenesis is made in accordance with Applied Example 6 to create a lymphocyte population expressing a tumor specific αβ TCR.

<Efficacy Assessment>

(1) When assessing efficacy, cancer cells derived from a patient is extracted/separated and thinly cut in a culture solution (RPMI 1640, 11875-093, Invitrogen) and then filtered with 0.70 μm filter (Falcon cell strainer, Corning) to separate a single cell. The cells are subjected to inactivation treatment for 2 hours at 37° C. with 10 µg/ml mitomycin C (Mitomycin C for injection, Kyowa Hakko Kirin) in the culture solution. After the inactivation treatment, the cells are mixed and cultured with T lymphocytes introduced with a tumor specific TCR gene made as described in Applied Example 6.

(2) Reactivity to a tumor cell is assessed by ELISPOT shown in Applied Example 8. That is, the lymphocytes introduced with a tumor specific TCR gene made in accordance with Applied Example 6 are mixed at a cell concentration of 1×10⁶/mL at a lymphocyte-tumor cell ratio (E:T ratio) of 2:1, 1:1, and 0.5:1 are cultured for 24 hours at 37° C. by using an ELISPOT kit (IFN-γ, Human, ELISpot Kit, EL285, R&D Systems).

(3) After 24 hours, cells are removed. Production of INFγ on a PVFD membrane is detected by a coloring method, and the number of IFNγ producing cells is counted to assess the tumor specificity of lymphocytes introduced with a tumor specific TCR gene. Besides ELISPOT, assessment can be performed by a cell proliferation test such as MTT assay (Cell Proliferation Kit I, MTT assay, 11465007001, Roche Diagnostics) or IL-2 production test (Human IL-2 ELISA system, GE Healthcare, RPN5965).

(Results)

The present Example accomplishes the following.

(1) When reactivity to an inactivated tumor cell of a tumor specific TCR gene recombinant lymphocyte is examined, production of IFNγ at a high frequency is recognized.

(2) The number of IFNγ positive cells increases over time during culturing, and reaches a plateau after 24 hours.

(Discussion)

It is understood from the present Example that the present invention accomplishes the following effect.

(1) Prior to administering gene therapy using a lymphocyte introduced with a tumor specific TCR gene, efficacy of using patient's own cell can be assessed. The efficacy can be predicted prior to therapy.

(2) A TCR gene can be selected and utilized by assessing efficacy. Thus, a more effective TCR gene therapy is possible.

<Safety Assessment>

(1') When assessing safety, the same test as (1) and (2) is carried out by using a control that is an existing cell line, normal tissue considered to be free of cancer cells of a patient (part of normal tissue collected in the process of tumor extraction) or peripheral blood cell of the patient in case of solid tumor.

(2') Reactivity of a T lymphocyte introduced with a tumor specific TCR gene to normal tissue is quantified and assessed by ELISPOT.

(3') A T lymphocyte introduced with a tumor specific TCR gene with low reactivity to normal cells and high reactivity to tumor cells is selected for use in therapy of a patient.

(Results)

The present Example accomplishes the following.

(1) When lymphocytes introduced with a tumor specific TCR gene are made to examine reactivity to inactivated normal cells, it can be understood that IFNγ is not produced and reactivity to normal cells is hardly exhibited.

(Discussion)

It is understood from the present Example that the present invention accomplishes the following effect.

(1) Prior to administering a high-risk gene therapy using a lymphocyte introduced with a tumor specific TCR gene, safety of using the patient's own cell can be assessed to materialize safer therapy.

(2) High risk TCR genes can be excluded to administer therapy using a safer TCR gene by assessing safety.

As described above, the present invention is exemplified by the use of its preferred Embodiments. However, it is understood that the scope of the present invention should be interpreted solely based on the claims. It is also understood that any patent, any patent application, and any references cited herein should be incorporated by reference in the present specification in the same manner as the contents are specifically described herein. The present application claims priority to Japanese Patent Application Nos. 2013-241403, 2013-241404, and 2013-241405, the entire content of which is incorporated herein by reference.

INDUSTRIAL APPLICABILITY

The present invention is especially useful in clinical applications where quantitative analysis is especially required and a sample is provided for highly precise, unbiased, large scale gene analysis.

SEQUENCE LISTING FREE TEXT

SEQ ID NOs: 1-19: primer sequence used in Example 1 (Table 1)
SEQ ID NOs: 20-31: CDR3 amino acid sequence of BCR read
SEQ ID NOs: 32-38: primer sequence used in Example 2 (Table 2)
SEQ ID NO: 39: sequence of Adaptor-A
SEQ ID NOs: 40-60: sequencing primer (Table 6)
SEQ ID NOs: 61-1164: CDR3 amino acid sequence of BCR read (Table 1H)
SEQ ID NOs: 1165-1324: TCR read in serially diluted Molt-4 cell samples
SEQ ID NOs: 1325-1374: example of molecule identification (MID Tag) sequence
SEQ ID NO: 1375: sequence of Adaptor-B
SEQ ID NOs: 1376-1379: each full length sequence of TCR
SEQ ID NOs: 1381-1386: each full length sequence of BCR
SEQ ID NO: 1387: specific sequence (CM3) in CM3-GS (SEQ ID NO: 7)
SEQ ID NO: 1388: specific sequence (CA3) in CA3-GS (SEQ ID NO: 10
SEQ ID NO: 1389: specific sequence (CG3) in CG3-GS (SEQ ID NO: 13
SEQ ID NO: 1390: specific sequence (CD3) in CD3-GS (SEQ ID NO: 16)
SEQ ID NO: 1391: specific sequence (CE3) in CE3-GS (SEQ ID NO: 19)
SEQ ID NO: 1392: target sequence TRBC, name TRBC2*01, membrane bound form
SEQ ID NO: 1393: target sequence TRBC, name TRBC2*02, membrane bound form SEQ ID NO: 1394: target sequence TRGC, name TRGC1*02, membrane bound form
SEQ ID NO: 1395: target sequence TRGC, name TRGC2*01, membrane bound form
SEQ ID NO: 1396: target sequence TRGC, name TRGC2*02, membrane bound form
SEQ ID NO: 1397: target sequence TRGC, name TRGC2*03, membrane bound form
SEQ ID NO: 1398: target sequence TRGC, name TRGC2*04, membrane bound form
SEQ ID NO: 1399: target sequence TRGC, name TRGC2*05, membrane bound form
SEQ ID NO: 1400: target sequence IGHA, name IGHA2*01, secreted form
SEQ ID NO: 1401: target sequence IGHA, name IGHA2*02s, secreted form
SEQ ID NO: 1402: target sequence IGHA, name IGHA2*02, membrane bound form
SEQ ID NO: 1403: target sequence IGHA, name IGHA2*03, secreted form
SEQ ID NO: 1404: target sequence IGHD, name IGHD*01, secreted form
SEQ ID NO: 1405: target sequence IGHD, name IGHD*02, secreted form
SEQ ID NO: 1406: target sequence IGHD, name IGHD*02, membrane bound form
SEQ ID NO: 1407: target sequence IGHE, name IGHE*01, membrane bound form
SEQ ID NO: 1408: target sequence IGHE, name IGHE*02, secreted form
SEQ ID NO: 1409: target sequence IGHE, name IGHE*03, membrane bound form
SEQ ID NO: 1410: target sequence IGHE, name IGHE*04, secreted form
SEQ ID NO: 1411: target sequence IGHE, name IGHE*04, membrane bound form
SEQ ID NO: 1412: target sequence IGHG, name IGHG1*02, secreted form
SEQ ID NO: 1413: target sequence IGHG, name IGHG1*03, secreted form
SEQ ID NO: 1414: target sequence IGHG, name IGHG2*0, secreted form
SEQ ID NO: 1415: target sequence IGHG, name IGHG2*01, membrane bound form
SEQ ID NO: 1416: target sequence IGHG, name IGHG2*02, secreted form
SEQ ID NO: 1417: target sequence IGHG, name IGHG2*03, secreted form
SEQ ID NO: 1418: target sequence IGHG, name IGHG2*04, secreted form
SEQ ID NO: 1419: target sequence IGHG, name IGHG2*05, secreted form
SEQ ID NO: 1420: target sequence IGHG, name IGHG2*06, secreted form
SEQ ID NO: 1421: target sequence IGHG, name IGHG2*06, membrane bound form
SEQ ID NO: 1422: target sequence IGHG, name IGHG3*01, secreted form
SEQ ID NO: 1423: target sequence IGHG, name IGHG3*01, membrane bound form
SEQ ID NO: 1424: target sequence IGHG, name IGHG3*03, secreted form
SEQ ID NO: 1425: target sequence IGHG, name IGHG3*03, membrane bound form
SEQ ID NO: 1426: target sequence IGHG, name IGHG3*04, secreted form
SEQ ID NO: 1427: target sequence IGHG, name IGHG3*05, secreted form
SEQ ID NO: 1428: target sequence IGHG, name IGHG3*06, secreted form
SEQ ID NO: 1429: target sequence IGHG, name IGHG3*07, secreted form
SEQ ID NO: 1430: target sequence IGHG, name IGHG3*08, secreted form
SEQ ID NO: 1431: target sequence IGHG, name IGHG3*09, secreted form
SEQ ID NO: 1432: target sequence IGHG, name IGHG3*10, secreted form
SEQ ID NO: 1433: target sequence IGHG, name IGHG3*11, secreted form
SEQ ID NO: 1434: target sequence IGHG, name IGHG3*12, secreted form
SEQ ID NO: 1435: target sequence IGHG, name IGHG3*13, secreted form
SEQ ID NO: 1436: target sequence IGHG, name IGHG3*14, secreted form
SEQ ID NO: 1437: target sequence IGHG, name IGHG3*15, secreted form
SEQ ID NO: 1438: target sequence IGHG, name IGHG3*16, secreted form
SEQ ID NO: 1439: target sequence IGHG, name IGHG3*17, secreted form
SEQ ID NO: 1440: target sequence IGHG, name IGHG3*18, secreted form
SEQ ID NO: 1441: target sequence IGHG, name IGHG3*19, secreted form
SEQ ID NO: 1442: target sequence IGHG, name IGHG4*01, secreted form
SEQ ID NO: 1443: target sequence IGHG, name IGHG4*02, secreted form
SEQ ID NO: 1444: target sequence IGHG, name IGHG4*03, secreted form
SEQ ID NO: 1445: target sequence IGHG, name IGHG4*04, secreted form
SEQ ID NO: 1446: target sequence IGHG, name IGHG4*04, membrane bound form
SEQ ID NO: 1447: target sequence IGHM, name IGHM*01, membrane bound form
SEQ ID NO: 1448: target sequence IGHM, name IGHM*03, secreted form
SEQ ID NO: 1449: target sequence IGHM, name IGHM*03, membrane bound form
SEQ ID NOs: 1450-1499: TRA reads (top 50) (Table 3-1)
SEQ ID NOs: 1500-1549: TRB reads (top 50) (Table 3-2)
SEQ ID NOs: 1550-1587: TCRα chain read sequence overlapping in healthy individuals (Table 3-7)
SEQ ID NOs: 1588-1626: TCRβ chain read sequence overlapping in healthy individuals (Table 3-8)
SEQ ID NOs: 1627-1647: invariant TCR candidate gene (Table 3-9)
SEQ ID NOs: 1648-1860: overlapping TCRα read sequence and cancer specific TCRα read in cancer patients (Table 3-11)
SEQ ID NOs: 1861-1909: overlapping TCRβ read sequence and cancer specific TCRβ in cancer patients (Table 3-12)
SEQ ID NOs: 1910-1921: P5-P20EA primer
SEQ ID NOs: 1922-1929: P7-CA3 primer
SEQ ID NOs: 1930-1937: P7-CB3 primer
SEQ ID NOs: 1938-1992: invariant TCR sequence observed in public TCRα sequence identified in Example 5 of analysis system

SEQUENCE LISTING (1992 sequences)

SEQ ID NO: 1 - DNA, 35 bp, artificial sequence
  BSL-18E  primer
  misc_feature (35)..(35): n is a, c, g, t or u
aaagcggccgcatgcttttttttttttttttttvn

SEQ ID NO: 2 - DNA, 20 bp, artificial sequence
  P20EA  primer
taatacgactccgaattccc

SEQ ID NO: 3 - DNA, 10 bp, artificial sequence
  P10EA  primer
gggaattcgg

SEQ ID NO: 4 - DNA, 20 bp, artificial sequence
  B-P20EA  primer
  modified_base (1)..(1): Adaptor B is attached
taatacgactccgaattccc

SEQ ID NO: 5 - DNA, 19 bp, artificial sequence
  CM1  primer
tcctgtgcgaggcagccaa

SEQ ID NO: 6 - DNA, 20 bp, artificial sequence
  CM2  primer
gtatccgacggggaattctc

SEQ ID NO: 7 - DNA, 19 bp, artificial sequence
  CM3GS  primer
  modified_base (1)..(1): Adaptor A-key-MID1 is attached
aaagggttggggcggatgc

SEQ ID NO: 8 - DNA, 20 bp, artificial sequence
  CA1  primer
gctggctgctcgtggtgtac

SEQ ID NO: 9 - DNA, 21 bp, artificial sequence
  CA2  primer
gggaagtttctggcggtcacg

SEQ ID NO: 10 - DNA, 20 bp, artificial sequence
  CA3-GS  primer
  modified_base (1)..(1): Adaptor A-key-MID2 is attached
ccgctttcgctccaggtcac

SEQ ID NO: 11 - DNA, 21 bp, artificial sequence
  CG1  primer
caccttggtgttgctgggctt

SEQ ID NO: 12 - DNA, 21 bp, artificial sequence
  CG2  primer
tcctgaggactgtaggacagc

SEQ ID NO: 13 - DNA, 21 bp, artificial sequence
  CG3-GS  primer
  modified_base (1)..(1): Adaptor A-key-MID3 is attached
tgagttccacgacaccgtcac

SEQ ID NO: 14 - DNA, 20 bp, artificial sequence
  CD1  primer
gtcccgtctttgtatctcag

SEQ ID NO: 15 - DNA, 18 bp, artificial sequence
  CD2  primer
tctgtgtccccatgtacc

SEQ ID NO: 16 - DNA, 19 bp, artificial sequence
  CD3-GS  primer
  modified_base (1)..(1): Adaptor A-key-MID4 is attached
cccagttatcaagcatgcc

SEQ ID NO: 17 - DNA, 18 bp, artificial sequence
  CE1  primer
catagtgaccagagagcg

SEQ ID NO: 18 - DNA, 19 bp, artificial sequence
  CE2  primer
gtggctggtaaggtcatag

SEQ ID NO: 19 - DNA, 20 bp, artificial sequence
  CE3-GS  primer
  modified_base (1)..(1): Adaptor A-key-MID5 is attached
cattggagggaatgtttttg

SEQ ID NO: 20 - protein, 17 aa, Homo sapiens
  IGHV4-59 and IGHJ4 and IGHD1-7
CARVVGNWNYEWIFDNW

SEQ ID NO: 21 - protein, 14 aa, Homo sapiens
  IGHV3-30-3 and IGHJ3 and IGHD5-12
CARMYRRVYGFDAW

SEQ ID NO: 22 - protein, 16 aa, Homo sapiens
  IGHV1-18 and IGHJ4 and IGHD2-21
CARRHYGDRGYYFDIW

SEQ ID NO: 23 - protein, 20 aa, Homo sapiens
  IGHV1-2 and IGHJ3 and IGHD6-13
CVRDRLPSWAAAGKDSFGLW

SEQ ID NO: 24 - protein, 24 aa, Homo sapiens
  IGHV4-34 and IGHJ6 and IGHD3-10
CARGRKLPVRGVRGMFYYYGVDVW

SEQ ID NO: 25 - protein, 24 aa, Homo sapiens
  IGHV4-39 and IGHJ6 and IGHD6-19
CARQIVRNSGWYVAWYNYYLLDLW

SEQ ID NO: 26 - protein, 25 aa, Homo sapiens
  IGHV4-59 and IGHJ3 and IGHD3-22
CARQSLYRIYYSDSSGYRLDAFDIW

SEQ ID NO: 27 - protein, 14 aa, Homo sapiens
  IGHV3-23 and IGHJ4 and IGHD3-10
CAKYLMILGHFDIW

SEQ ID NO: 28 - protein, 15 aa, Homo sapiens
  IGHV2-70 and IGHJ4 and IGHD6-13
CARLLGSGWYHFDKW

SEQ ID NO: 29 - protein, 22 aa, Homo sapiens
  IGHV1-69 and IGHJ4 and IGHD5-24
CARGRPSRDGYRPPMYYFLDYW

SEQ ID NO: 30 - protein, 17 aa, Homo sapiens
  IGHV3-21 and IGHJ3 and IGHD2-2
CARGCSANCPTVAFDLW

SEQ ID NO: 31 - protein, 17 aa, Homo sapiens
  IGHV3-23 and IGHJ5 and IGHD6-19
CAKDRGNSGWWSWLDPW

SEQ ID NO: 32 - DNA, 35 bp, artificial sequence; identical to SEQ ID NO: 1
  BSL-18E  primer
  misc_feature (35)..(35): n is a, c, g, t or u

SEQ ID NO: 33 - DNA, 20 bp, artificial sequence
  P20EA  primer
taatacgactccgaattccc

SEQ ID NO: 34 - DNA, 10 bp, artificial sequence
  P10EA  primer
gggaattcgg

SEQ ID NO: 35 - DNA, 23 bp, artificial sequence
  CA1  primer
tgttgaaggcgtttgcacatgca

SEQ ID NO: 36 - DNA, 23 bp, artificial sequence
  CA2  primer
gtgcatagacctcatgtctagca

SEQ ID NO: 37 - DNA, 23 bp, artificial sequence
  CB1  primer
gaactggacttgacagcggaact

SEQ ID NO: 38 - DNA, 23 bp, artificial sequence
  CB2  primer
aggcagtatctggagtcattgag

SEQ ID NO: 39 - DNA, 26 bp, artificial sequence
  A adaptor
ccatctcatccctgcgtgtctccgac

SEQ ID NO: 40 - DNA, 63 bp, artificial sequence
  HuVaF-02  primer
ccatctcatccctgcgtgtctccgactcagacgagtgcgtataggcagacagacttgtcactg

SEQ ID NO: 41 - DNA, 63 bp, artificial sequence
  HuVaF-02  primer
ccatctcatccctgcgtgtctccgactcagacgctcgacaataggcagacagacttgtcactg

SEQ ID NO: 42 - DNA, 63 bp, artificial sequence
  HuVaF-03  primer
ccatctcatccctgcgtgtctccgactcagagacgcactcataggcagacagacttgtcactg

SEQ ID NO: 43 - DNA, 63 bp, artificial sequence
  HuVaF-04  primer
ccatctcatccctgcgtgtctccgactcagagcactgtagataggcagacagacttgtcactg

SEQ ID NO: 44 - DNA, 63 bp, artificial sequence
  HuVaF-05  primer
ccatctcatccctgcgtgtctccgactcagatcagacacgataggcagacagacttgtcactg

SEQ ID NO: 45 - DNA, 63 bp, artificial sequence
  HuVaF-06  primer
ccatctcatccctgcgtgtctccgactcagatatcgcgagataggcagacagacttgtcactg

SEQ ID NO: 46 - DNA, 63 bp, artificial sequence
  HuVaF-07  primer
ccatctcatccctgcgtgtctccgactcagcgtgtctctaataggcagacagacttgtcactg

SEQ ID NO: 47 - DNA, 63 bp, artificial sequence
  HuVaF-08  primer
ccatctcatccctgcgtgtctccgactcagctcgcgtgtcataggcagacagacttgtcactg

SEQ ID NO: 48 - DNA, 63 bp, artificial sequence
  HuVaF-09  primer
ccatctcatccctgcgtgtctccgactcagtctctatgcgataggcagacagacttgtcactg

SEQ ID NO: 49 - DNA, 63 bp, artificial sequence
  HuVaF-10  primer
ccatctcatccctgcgtgtctccgactcagtgatacgtctataggcagacagacttgtcactg

SEQ ID NO: 50 - DNA, 63 bp, artificial sequence
  HuVbF-01  primer
ccatctcatccctgcgtgtctccgactcagatacgacgtaacaccagtgtggccttttgggtg

SEQ ID NO: 51 - DNA, 63 bp, artificial sequence
  HuVbF-02  primer
ccatctcatccctgcgtgtctccgactcagtcacgtactaacaccagtgtggccttttgggtg

SEQ ID NO: 52 - DNA, 63 bp, artificial sequence
  HuVbF-03  primer
ccatctcatccctgcgtgtctccgactcagcgtctagtacacaccagtgtggccttttgggtg

SEQ ID NO: 53 - DNA, 63 bp, artificial sequence
  HuVbF-04  primer
ccatctcatccctgcgtgtctccgactcagtctacgtagcacaccagtgtggccttttgggtg

SEQ ID NO: 54 - DNA, 63 bp, artificial sequence
  HuVbF-05  primer
ccatctcatccctgcgtgtctccgactcagtgtactactcacaccagtgtggccttttgggtg

SEQ ID NO: 55 - DNA, 63 bp, artificial sequence
  HuVbF-06  primer
ccatctcatccctgcgtgtctccgactcagacgactacagacaccagtgtggccttttgggtg

SEQ ID NO: 56 - DNA, 63 bp, artificial sequence
  HuVbF-07  primer
ccatctcatccctgcgtgtctccgactcagcgtagactagacaccagtgtggccttttgggtg

SEQ ID NO: 57 - DNA, 63 bp, artificial sequence
  HuVbF-08  primer
ccatctcatccctgcgtgtctccgactcagtacgagtatgacaccagtgtggccttttgggtg

SEQ ID NO: 58 - DNA, 63 bp, artificial sequence
  HuVbF-09  primer
ccatctcatccctgcgtgtctccgactcagtactctcgtgacaccagtgtggccttttgggtg

SEQ ID NO: 59 - DNA, 63 bp, artificial sequence
  HuVbF-10  primer
ccatctcatccctgcgtgtctccgactcagtagagacgagacaccagtgtggccttttgggtg

SEQ ID NO: 60 - DNA, 46 bp, artificial sequence
  B-P20EA  primer
cctatcccctgtgtgccttggcagtctaatacgactccgaattccc

SEQ ID NO: 61 - protein, 26 aa, Homo sapiens
  IGHD2-21  CDR3 amino acids
CAKDMCGLWASCGGDCYSRRTTSLTT

SEQ ID NO: 62 - protein, 26 aa, Homo sapiens
  IGHD2-21  CDR3 amino acids
CAKDMCGLWASCGGDCYSRRTASLTT

SEQ ID NO: 63 - protein, 21 aa, Homo sapiens
  IGHD2-21  CDR3 amino acids
CARGPNMAFVVVTAILMLLIS

SEQ ID NO: 64 - protein, 23 aa, Homo sapiens
  IGHD2-21  CDR3 amino acids
CARAPDCGGSTCYSHPYYGMDVW

SEQ ID NO: 65 - protein, 20 aa, Homo sapiens
  IGHD2-21  CDR3 amino acids
CARSHIVVVTAIPLEMLLIS

SEQ ID NO: 66 - protein, 23 aa, Homo sapiens
  IGHD2-21  CDR3 amino acids
CARDPRIVVVAPATHTPTTVWTS

SEQ ID NO: 67 - protein, 15 aa, Homo sapiens
  IGHD6-13  CDR3 amino acids
CGRSRHSSSWQILTP

SEQ ID NO: 68 - protein, 15 aa, Homo sapiens
  IGHD6-13  CDR3 amino acids
CANGGLAAAGDHLTT

SEQ ID NO: 69 - protein, 16 aa, Homo sapiens
  IGHD6-13  CDR3 amino acids
CALCPTPIAAAGSVTT

SEQ ID NO: 70 - protein, 19 aa, Homo sapiens
  IGHD6-13  CDR3 amino acids
CARAPSIPVAGIGYHFDHW

SEQ ID NO: 71 - protein, 17 aa, Homo sapiens
  IGHD6-13  CDR3 amino acids
CALCPNPYSSGWFCNYW

SEQ ID NO: 72 - protein, 18 aa, Homo sapiens
  IGHD6-13  CDR3 amino acids
CARAPSIPVAGIATTLTT

SEQ ID NO: 73 - protein, 16 aa, Homo sapiens
  IGHD3-3  CDR3 amino acids
CIYDFWSGGPHPTLTT

SEQ ID NO: 74 - protein, 17 aa, Homo sapiens
  IGHD3-3  CDR3 amino acids
CARIVNTEGFWSGFLTP

SEQ ID NO: 75 - protein, 14 aa, Homo sapiens
  IGHD3-3  CDR3 amino acids
CTRRGGVVIICLTT

SEQ ID NO: 76 - protein, 18 aa, Homo sapiens
  IGHD3-3  CDR3 amino acids
CIHTGNDFWTGTNYGLTS

SEQ ID NO: 77 - protein, 17 aa, Homo sapiens
  IGHD3-3  CDR3 amino acids
CARIVNTEGFGVVFLTP

SEQ ID NO: 78 - protein, 23 aa, Homo sapiens
  IGHD3-3  CDR3 amino acids
CAKDRFSGRGRFEFMEWLTPLTT

SEQ ID NO: 79 - protein, 22 aa, Homo sapiens
  IGHD3-3  CDR3 amino acids
CAKDRFSEGKVQFMEWLTPLTT

SEQ ID NO: 80 - protein, 20 aa, Homo sapiens
  IGHD3-22  CDR3 amino acids
CARRPIPPLTMRVVVIPLTS

SEQ ID NO: 81 - protein, 17 aa, Homo sapiens
  IGHD3-22  CDR3 amino acids
CARDPPMPMIVVQTLTT

SEQ ID NO: 82 - protein, 17 aa, Homo sapiens
  IGHD3-22  CDR3 amino acids
CARDPPMPMILVQTLTT

SEQ ID NO: 83 - protein, 19 aa, Homo sapiens
  IGHD3-22  CDR3 amino acids
CAKILITMILVVSLMLLIS

SEQ ID NO: 84 - protein, 23 aa, Homo sapiens
  IGHD3-10  CDR3 amino acids
CAREIRGTTMVRELTTSTATWTP

SEQ ID NO: 85 - protein, 23 aa, Homo sapiens
  IGHD3-10  CDR3 amino acids
CVRTYYFGLGDIITEITSTVWTS

SEQ ID NO: 86 - protein, 18 aa, Homo sapiens
  IGHD3-10  CDR3 amino acids
CATYYYGSGSAGHNFDYW

SEQ ID NO: 87 - protein, 15 aa, Homo sapiens
  IGHD3-10  CDR3 amino acids
CARRTYYYGSTNLTT

SEQ ID NO: 88 - protein, 20 aa, Homo sapiens
  IGHD3-10  CDR3 amino acids
CARMVTDYYGSGNRGWFDPW

SEQ ID NO: 89 - protein, 24 aa, Homo sapiens
  IGHD3-10  CDR3 amino acids
CARGPGLSVMIRGVITTPNHILIT

SEQ ID NO: 90 - protein, 13 aa, Homo sapiens
  IGHD3-10  CDR3 amino acids
CARDYYGSGVMTL

SEQ ID NO: 91 - protein, 22 aa, Homo sapiens
  IGHD2-15  CDR3 amino acids
CARAPDCGGGTCYSHPTTVWTS

SEQ ID NO: 92 - protein, 22 aa, Homo sapiens
  IGHD2-15  CDR3 amino acids
CARARIVVVVPATLTPTTVWTS

SEQ ID NO: 93 - protein, 23 aa, Homo sapiens
  IGHD2-15  CDR3 amino acids
CARAPDCGGGTCYSHPYYGMDVW

SEQ ID NO: 94 - protein, 26 aa, Homo sapiens
  IGHD2-15  CDR3 amino acids
CAKDLAPLKSCSRGGCYPYYYGLDIW

SEQ ID NO: 95 - protein, 18 aa, Homo sapiens
  IGHD1-26  CDR3 amino acids
CARGPATAILGATPSLTP

SEQ ID NO: 96 - protein, 14 aa, Homo sapiens
  IGHD1-26  CDR3 amino acids
CARDDSASYSRGTT

SEQ ID NO: 97 - protein, 18 aa, Homo sapiens
  IGHD1-26  CDR3 amino acids
CVRHDYSDNDLSTNWFGP

SEQ ID NO: 98 - protein, 9 aa, Homo sapiens
  IGHD5-5  CDR3 amino acids
CMGPGDTAI

SEQ ID NO: 99 - protein, 18 aa, Homo sapiens
  IGHD5-5  CDR3 amino acids
CARRPREMESAMVLSLTT

SEQ ID NO: 100 - protein, 25 aa, Homo sapiens
  IGHD3-9  CDR3 amino acids
CAHSAPYYDILSRNRARSWKDFDNW

SEQ ID NO: 101 - protein, 24 aa, Homo sapiens
  IGHD3-9  CDR3 amino acids
CAHSAPIMIFCLVTAHEVGRILTT

SEQ ID NO: 102 - protein, 16 aa, Homo sapiens
  IGHD3-9  CDR3 amino acids
CATVALLRYFDWSSTR

SEQ ID NO: 103 - protein, 26 aa, Homo sapiens
  IGHD6-19  CDR3 amino acids
CARGRRSLPAIVYSSGPDRPNWFDPW

SEQ ID NO: 104 - protein, 20 aa, Homo sapiens
  IGHD6-19  CDR3 amino acids
CTSAAVASSSGWPLRGVWTS

SEQ ID NO: 105 - protein, 19 aa, Homo sapiens
  IGHD2-2  CDR3 amino acids
CARAPLCSSASCHLQLDYW

SEQ ID NO: 106 - protein, 16 aa, Homo sapiens
  IGHD4-23  CDR3 amino acids
CARGAGYGGNSGVRTT

SEQ ID NO: 107 - protein, 12 aa, Homo sapiens
  IGHD4-17  CDR3 amino acids
CARTLYGDFVDF

SEQ ID NO: 108 - protein, 20 aa, Homo sapiens
  IGHD3-16  CDR3 amino acids
CAKGVLSSGGVIATLPGSTP

SEQ ID NO: 109 - protein, 13 aa, Homo sapiens
  IGHD3-16  CDR3 amino acids
CARGFGARGVILT

SEQ ID NO: 110 - protein, 25 aa, Homo sapiens
  IGHD2-8  CDR3 amino acids
CANVGGADRNYCINGVRHNPNYLTT

SEQ ID NO: 111 - protein, 17 aa, Homo sapiens
  IGHD5-12  CDR3 amino acids
CARHVNGYDYLFPFTSW

SEQ ID NO: 112 - protein, 17 aa, Homo sapiens
  IGHD1-1  CDR3 amino acids
CARGGSQLERRRPLVTT

SEQ ID NO: 113 - protein, 12 aa, Homo sapiens
  IgA  CDR3 amino acids
CARETVGGTLTT

SEQ ID NO: 114 - protein, 18 aa, Homo sapiens
  IgA  CDR3 amino acids
CARISSGHDPPIITGWTS

SEQ ID NO: 115 - protein, 18 aa, Homo sapiens
  IgA  CDR3 amino acids
CAKGHQVRLRGRTGTSIS

SEQ ID NO: 116 - protein, 19 aa, Homo sapiens
  IgA  CDR3 amino acids
CARSPIWFGSHRFTTTWRS

SEQ ID NO: 117 - protein, 15 aa, Homo sapiens
  IgA  CDR3 amino acids
CARDPLETGATSLII

SEQ ID NO: 118 - protein, 20 aa, Homo sapiens
  IgA  CDR3 amino acids
CAKLGNRPGFTEWDHWFGPW

SEQ ID NO: 119 - protein, 22 aa, Homo sapiens
  IgA  CDR3 amino acids
CAGAPDCGVGAAPLTSTTVCTS

SEQ ID NO: 120 - protein, 15 aa, Homo sapiens
  IgA  CDR3 amino acids
CVRDPHETGATTLIT

SEQ ID NO: 121 - protein, 17 aa, Homo sapiens
  IgA  CDR3 amino acids
CARIRKEVGAPPITWTS

SEQ ID NO: 122 - protein, 16 aa, Homo sapiens
  IgA  CDR3 amino acids
CARGSWSGAAFYSLTT

SEQ ID NO: 123 - protein, 16 aa, Homo sapiens
  IgA  CDR3 amino acids
CARDPNKFRTNHLSTT

SEQ ID NO: 124 - protein, 18 aa, Homo sapiens
  IgA  CDR3 amino acids
CAGIGGATSTTTTTTWTS

SEQ ID NO: 125 - protein, 20 aa, Homo sapiens
  IgA  CDR3 amino acids
CATVPELTDISLPRLMALIS

SEQ ID NO: 126 - protein, 12 aa, Homo sapiens
  IgA  CDR3 amino acids
CARVWGKHTLTT

SEQ ID NO: 127 - protein, 16 aa, Homo sapiens
  IgA  CDR3 amino acids
CARRAAPHDYGHVLIF

SEQ ID NO: 128 - protein, 16 aa, Homo sapiens
  IgA  CDR3 amino acids
CARDPNKFRPNHLSTT

SEQ ID NO: 129 - protein, 15 aa, Homo sapiens
  IgA  CDR3 amino acids
CARAGRELLRALMTT

SEQ ID NO: 130 - protein, 15 aa, Homo sapiens
  IgA  CDR3 amino acids
CARAGAELLRALMTT

SEQ ID NO: 131 - protein, 18 aa, Homo sapiens
  IgA  CDR3 amino acids
CARAEDYYDTEGYFYLTP

SEQ ID NO: 132 - protein, 20 aa, Homo sapiens
  IgA  CDR3 amino acids
CAHRTNYSTNRYGAFTTLTS

SEQ ID NO: 133 - protein, 15 aa, Homo sapiens
  IgA  CDR3 amino acids
CVRHDGSFTKTGSTP

SEQ ID NO: 134 - protein, 15 aa, Homo sapiens
  IgA  CDR3 amino acids
CVRDPQETGATTLIT

SEQ ID NO: 135 - protein, 8 aa, Homo sapiens
  IgA  CDR3 amino acids
CVKIGAAH

SEQ ID NO: 136 - protein, 20 aa, Homo sapiens
  IgA  CDR3 amino acids
CATQCLGGAGLTTTTAPWTS

SEQ ID NO: 137 - protein, 15 aa, Homo sapiens
  IgA  CDR3 amino acids
CARRTYYSGSTNLTT

SEQ ID NO: 138 - protein, 14 aa, Homo sapiens
  IgA  CDR3 amino acids
CARRTTRETGSSIS

SEQ ID NO: 139 - protein, 25 aa, Homo sapiens
  IgA  CDR3 amino acids
CARLRCSNDNCAGHLYYYFSGLDIW

SEQ ID NO: 140 - protein, 13 aa, Homo sapiens
  IgA  CDR3 amino acids
CARASLPRGLLIS

SEQ ID NO: 141 - protein, 16 aa, Homo sapiens
  IgA  CDR3 amino acids
CAKGRGRRAAGKFLTT

SEQ ID NO: 142 - protein, 14 aa, Homo sapiens
  IgA  CDR3 amino acids
CVRQYGLGSGSLTP

SEQ ID NO: 143 - protein, 15 aa, Homo sapiens
  IgA  CDR3 amino acids
CVKIRNLIGFTGSTP

SEQ ID NO: 144 - protein, 16 aa, Homo sapiens
  IgA  CDR3 amino acids
CTRDGVRGDLNPTLNV

SEQ ID NO: 145 - protein, 16 aa, Homo sapiens
  IgA  CDR3 amino acids
CTKGGGRKTAGKFLTP

SEQ ID NO: 146 - protein, 12 aa, Homo sapiens
  IgA  CDR3 amino acids
CDKAKVTADLRT

SEQ ID NO: 147 - protein, 20 aa, Homo sapiens
  IgA  CDR3 amino acids
CATVPELPDISLPRLMALIS

SEQ ID NO: 148 - protein, 14 aa, Homo sapiens
  IgA  CDR3 amino acids
CATVFGRRYRLLTT

SEQ ID NO: 149 - protein, 15 aa, Homo sapiens
  IgA  CDR3 amino acids
CARYRAAYPRRAWTS

SEQ ID NO: 150 - protein, 20 aa, Homo sapiens
  IgA  CDR3 amino acids
CARTIGFEIAMTGGLGALTP

SEQ ID NO: 151 - protein, 10 aa, Homo sapiens
  IgA  CDR3 amino acids
CARTARTGDL

SEQ ID NO: 152 - protein, 18 aa, Homo sapiens
  IgA  CDR3 amino acids
CARRDPPVRASLSTTLTS

SEQ ID NO: 153 - protein, 22 aa, Homo sapiens
  IgA  CDR3 amino acids
CARIGHEFYSLTYSVNDVFDLW

SEQ ID NO: 154 - protein, 23 aa, Homo sapiens
  IgA  CDR3 amino acids
CARFQRYCRGGSCSATLDAFDKW

SEQ ID NO: 155 - protein, 20 aa, Homo sapiens
  IgA  CDR3 amino acids
CARDLGERRDGEPTNWFDAW

SEQ ID NO: 156 - protein, 13 aa, Homo sapiens
  IgA  CDR3 amino acids
CARDLAVWATLTT

SEQ ID NO: 157 - protein, 16 aa, Homo sapiens
  IgA  CDR3 amino acids
CAKGAGRRAAGKFLTT

SEQ ID NO: 158 - protein, 17 aa, Homo sapiens
  IgA  CDR3 amino acids
CAKDVEPTVTLYNHFDP

SEQ ID NO: 159 - protein, 11 aa, Homo sapiens
  IgA  CDR3 amino acids
CAKDFNWEGIT

SEQ ID NO: 160 - protein, 21 aa, Homo sapiens
  IgA  CDR3 amino acids
CAHRTNYSTNRYGGLYYFDFW

SEQ ID NO: 161 - protein, 13 aa, Homo sapiens
  IgA  CDR3 amino acids
CVRGVGTILWLTI

SEQ ID NO: 162 - protein, 20 aa, Homo sapiens
  IgA  CDR3 amino acids
CVRFIGAYSNNWYPGYFDYW

SEQ ID NO: 163 - protein, 13 aa, Homo sapiens
  IgA  CDR3 amino acids
CVRDAGPGGSLTS

SEQ ID NO: 164 - protein, 27 aa, Homo sapiens
  IgA  CDR3 amino acids
CTTGFSGSTACHWDHTACHWDDAFAMW

SEQ ID NO: 165 - protein, 15 aa, Homo sapiens
  IgA  CDR3 amino acids
CTHAVESLLGTTSTS

SEQ ID NO: 166 - protein, 18 aa, Homo sapiens
  IgA  CDR3 amino acids
CIHTGNDFGPGPTMVWTS

SEQ ID NO: 167 - protein, 16 aa, Homo sapiens
  IgA  CDR3 amino acids
CGVGRGDNDVDFKFKW

SEQ ID NO: 168 - protein, 10 aa, Homo sapiens
  IgA  CDR3 amino acids
CATRESPLTT

SEQ ID NO: 169 - protein, 15 aa, Homo sapiens
  IgA  CDR3 amino acids
CATAGIELWRAGSTP

SEQ ID NO: 170 - protein, 16 aa, Homo sapiens
  IgA  CDR3 amino acids
CASQSQNYYYYYMDVW

SEQ ID NO: 171 - protein, 16 aa, Homo sapiens
  IgA  CDR3 amino acids
CASKKEILWAGPNLTT

SEQ ID NO: 172 - protein, 17 aa, Homo sapiens
  IgA  CDR3 amino acids
CARYRIAMATSPYFDYW

SEQ ID NO: 173 - protein, 17 aa, Homo sapiens
  IgA  CDR3 amino acids
CARVRCGLVASEGVLIS

SEQ ID NO: 174 - protein, 22 aa, Homo sapiens
  IgA  CDR3 amino acids
CARTNFGSGGYILGDTTMVWTS

SEQ ID NO: 175 - protein, 13 aa, Homo sapiens
  IgA  CDR3 amino acids
CARSAGYLHRRTS

SEQ ID NO: 176 - protein, 16 aa, Homo sapiens
  IgA  CDR3 amino acids
CARRTYYSGSTNFDYW

SEQ ID NO: 177 - protein, 18 aa, Homo sapiens
  IgA  CDR3 amino acids
CARRDLPFGASLSTTLTS

SEQ ID NO: 178 - protein, 16 aa, Homo sapiens
  IgA  CDR3 amino acids
CARRAAPMTTGMFLIF

SEQ ID NO: 179 - protein, 14 aa, Homo sapiens
  IgA  CDR3 amino acids
CARPGFSYGPRLTP

SEQ ID NO: 180 - protein, 22 aa, Homo sapiens
  IgA  CDR3 amino acids
CARLRGGFPPVVKRVEVFLLTS

SEQ ID NO: 181 - protein, 16 aa, Homo sapiens
  IgA  CDR3 amino acids
CARKKIPTAGYSSLTT

SEQ ID NO: 182 - protein, 16 aa, Homo sapiens
  IgA  CDR3 amino acids
CARGSWMGRPFISLTT

SEQ ID NO: 183 - protein, 16 aa, Homo sapiens
  IgA  CDR3 amino acids
CARGRFARGGDDSLIS

SEQ ID NO: 184 - protein, 10 aa, Homo sapiens
  IgA  CDR3 amino acids
CARGLRWADN

SEQ ID NO: 185 - protein, 20 aa, Homo sapiens
  IgA  CDR3 amino acids
CARGGTSGLILDTTSTPWTS

SEQ ID NO: 186 - protein, 19 aa, Homo sapiens
  IgA  CDR3 amino acids
CAREMHIDSLTVGRAFDIW

SEQ ID NO: 187 - protein, 16 aa, Homo sapiens
  IgA  CDR3 amino acids
CARDVPDIYSSGATDC

SEQ ID NO: 188 - protein, 15 aa, Homo sapiens
  IgA  CDR3 amino acids
CARDPSYLPTPALKT

SEQ ID NO: 189 - protein, 17 aa, Homo sapiens
  IgA  CDR3 amino acids
CARDPNKFRPNHFVDYW

SEQ ID NO: 190 - protein, 15 aa, Homo sapiens
  IgA  CDR3 amino acids
CARDLGTTNYWLDTW

SEQ ID NO: 191 - protein, 13 aa, Homo sapiens
  IgA  CDR3 amino acids
CAKQRASGNSLTI

SEQ ID NO: 192 - protein, 17 aa, Homo sapiens
  IgA  CDR3 amino acids
CAKEPKIVGRRRTTLIT

SEQ ID NO: 193 - protein, 20 aa, Homo sapiens
  IgA  CDR3 amino acids
CAKDLGVCSEGAASSLVLIS

SEQ ID NO: 194 - protein, 13 aa, Homo sapiens
  IgA  CDR3 amino acids
CAKAPGDLCRSTP

SEQ ID NO: 195 - protein, 24 aa, Homo sapiens
  IgA  CDR3 amino acids
CAHSAPYYDICLVTAHEVGRILTT

SEQ ID NO: 196 - protein, 13 aa, Homo sapiens
  IgA  CDR3 amino acids
CAGLIGRFIPLTT

SEQ ID NO: 197 - protein, 19 aa, Homo sapiens
  IgA  CDR3 amino acids
CAGIRGSNIYYHYYYMDVW

SEQ ID NO: 198 - protein, 13 aa, Homo sapiens
  IgA  CDR3 amino acids
CADLPGIIGGEIT

SEQ ID NO: 199 - protein, 26 aa, Homo sapiens
  IGHD3-22  CDR3 amino acids
CARHDTPRVYYDSSGYYYGVDYFDYW

SEQ ID NO: 200 - protein, 26 aa, Homo sapiens
  IGHD3-22  CDR3 amino acids
CASMDTKNYYDSSGSQPRRSYYFDYW

SEQ ID NO: 201 - protein, 20 aa, Homo sapiens
  IGHD3-22  CDR3 amino acids
CAQYYYDSSGYYYYYGMDVW

SEQ ID NO: 202 - protein, 18 aa, Homo sapiens
  IGHD3-22  CDR3 amino acids
CARISYYYDSSGYYYRDW

SEQ ID NO: 203 - protein, 18 aa, Homo sapiens
  IGHD3-22  CDR3 amino acids
CARVRGITMIVVVTTLTT

SEQ ID NO: 204 - protein, 25 aa, Homo sapiens
  IGHD3-22  CDR3 amino acids
CASMDTKNYYDSSGSQPGGRTTLTT

SEQ ID NO: 205 - protein, 25 aa, Homo sapiens
  IGHD3-22  CDR3 amino acids
CASMDTKITMIVVVPNPGGRTTLTT

SEQ ID NO: 206 - protein, 12 aa, Homo sapiens
  IGHD3-22  CDR3 amino acids
CARYNYTIVVGP

SEQ ID NO: 207 - protein, 17 aa, Homo sapiens
  IGHD3-22  CDR3 amino acids
CARISYYYDSSGYYTVT

SEQ ID NO: 208 - protein, 19 aa, Homo sapiens
  IGHD3-22  CDR3 amino acids
CARIRYYYDSSGYYYFDYW

SEQ ID NO: 209 - protein, 18 aa, Homo sapiens
  IGHD3-22  CDR3 amino acids
CARHVRDGMIVVAEIDYW

SEQ ID NO: 210 - protein, 17 aa, Homo sapiens
  IGHD3-22  CDR3 amino acids
CARVAVRSYYPFGMDVW

SEQ ID NO: 211 - protein, 15 aa, Homo sapiens
  IGHD3-22  CDR3 amino acids
CARLPLDSSGYYLTT

SEQ ID NO: 212 - protein, 16 aa, Homo sapiens
  IGHD3-22  CDR3 amino acids
CARLPLDSSGYYFDYW

SEQ ID NO: 213 - protein, 26 aa, Homo sapiens
  IGHD3-22  CDR3 amino acids
CASMDTKNYYDSSGSQPRRSHYFDYW

SEQ ID NO: 214 - protein, 17 aa, Homo sapiens
  IGHD3-22  CDR3 amino acids
CARYRITMIVVVITTVT

SEQ ID NO: 215 - protein, 13 aa, Homo sapiens
  IGHD3-22  CDR3 amino acids
CARYNYYDSSGSW

SEQ ID NO: 216 - protein, 19 aa, Homo sapiens
  IGHD3-22  CDR3 amino acids
CARVRGYYDSMSMSALLMS

SEQ ID NO: 217 - protein, 19 aa, Homo sapiens
  IGHD3-22  CDR3 amino acids
CARVRGTMIVVSMSALLMS

SEQ ID NO: 218 - protein, 19 aa, Homo sapiens
  IGHD3-22  CDR3 amino acids
CARVRGNYYDSSGYYFDYW

SEQ ID NO: 219 - protein, 16 aa, Homo sapiens
  IGHD3-22  CDR3 amino acids
CARSGRVGARPKLYYW

SEQ ID NO: 220 - protein, 17 aa, Homo sapiens
  IGHD3-22  CDR3 amino acids
CARISYYYDVVVITTVT

SEQ ID NO: 221 - protein, 17 aa, Homo sapiens
  IGHD3-22  CDR3 amino acids
CARHVRDGMIVVAEMTT

SEQ ID NO: 222 - protein, 26 aa, Homo sapiens
  IGHD3-22  CDR3 amino acids
CARHDTPRAYYDSSGYYYGVDYFDYW

SEQ ID NO: 223 - protein, 21 aa, Homo sapiens
  IGHD3-22  CDR3 amino acids
CAREFFGTRTMIVVVTYFDYW

SEQ ID NO: 224 - protein, 19 aa, Homo sapiens
  IGHD3-22  CDR3 amino acids
CAQYYYDSMVITTTTVWTS

SEQ ID NO: 225 - protein, 18 aa, Homo sapiens
  IGHD3-10  CDR3 amino acids
CARGVRGVIINTFTTLTT

SEQ ID NO: 226 - protein, 14 aa, Homo sapiens
  IGHD3-10  CDR3 amino acids
CTWFGEATTTVWTS

SEQ ID NO: 227 - protein, 18 aa, Homo sapiens
  IGHD3-10  CDR3 amino acids
CARGGSGVIINTFTTLTT

SEQ ID NO: 228 - protein, 19 aa, Homo sapiens
  IGHD3-10  CDR3 amino acids
CARCAGGSGSYYYYYMEVW

SEQ ID NO: 229 - protein, 17 aa, Homo sapiens
  IGHD3-10  CDR3 amino acids
CVKAGFGELLIGGDRTT

SEQ ID NO: 230 - protein, 19 aa, Homo sapiens
  IGHD3-10  CDR3 amino acids
CARGGSGSYYKHVYYFDYW

SEQ ID NO: 231 - protein, 18 aa, Homo sapiens
  IGHD3-10  CDR3 amino acids
CARCAGGSGVTTTTTWRS

SEQ ID NO: 232 - protein, 15 aa, Homo sapiens
  IGHD3-10  CDR3 amino acids
CTWFGGGYYYGMDVW

SEQ ID NO: 233 - protein, 14 aa, Homo sapiens
  IGHD3-10  CDR3 amino acids
CTWFGGATTTVWTS

SEQ ID NO: 234 - protein, 16 aa, Homo sapiens
  IGHD3-10  CDR3 amino acids
CARLDGSGRRGTALTT

SEQ ID NO: 235 - protein, 16 aa, Homo sapiens
  IGHD3-10  CDR3 amino acids
CARLDVRGGRGTALTT

SEQ ID NO: 236 - protein, 18 aa, Homo sapiens
  IGHD3-10  CDR3 amino acids
CARGGSGVIINTFTTLTM

SEQ ID NO: 237 - protein, 18 aa, Homo sapiens
  IGHD3-10  CDR3 amino acids
CARCAGVRGVTTTTTWRS

SEQ ID NO: 238 - protein, 19 aa, Homo sapiens
  IGHD3-16  CDR3 amino acids
CARRVMITFGELSSTTLTT

SEQ ID NO: 239 - protein, 19 aa, Homo sapiens
  IGHD3-16  CDR3 amino acids
CARRVMITFGGVIVTTLTM

SEQ ID NO: 240 - protein, 20 aa, Homo sapiens
  IGHD3-16  CDR3 amino acids
CARRVMITFGGVIVDYFDYW

SEQ ID NO: 241 - protein, 19 aa, Homo sapiens
  IGHD3-16  CDR3 amino acids
CARRVMITFGGVIVDTLTT

SEQ ID NO: 242 - protein, 14 aa, Homo sapiens
  IGHD3-16  CDR3 amino acids
CANPTSFRQCSMTT

SEQ ID NO: 243 - protein, 19 aa, Homo sapiens
  IGHD3-16  CDR3 amino acids
CARRVMITLGELSSTTLTT

SEQ ID NO: 244 - protein, 19 aa, Homo sapiens
  IGHD3-16  CDR3 amino acids
CARRAMITFGELSSTTLTT

SEQ ID NO: 245 - protein, 15 aa, Homo sapiens
  IGHD6-19  CDR3 amino acids
CARHGIAVAYYFDYW

SEQ ID NO: 246 - protein, 20 aa, Homo sapiens
  IGHD6-19  CDR3 amino acids
CARVSSGWSGGNPAPATLTT

SEQ ID NO: 247 - protein, 15 aa, Homo sapiens
  IGHD6-19  CDR3 amino acids
CARHVGSGWVYFDYW

SEQ ID NO: 248 - protein, 16 aa, Homo sapiens
  IGHD6-19  CDR3 amino acids
CARRDDSSGWYGHDYW

SEQ ID NO: 249 - protein, 15 aa, Homo sapiens
  IGHD6-19  CDR3 amino acids
CARGYSSGFGDALIP

SEQ ID NO: 250 - protein, 20 aa, Homo sapiens
  IGHD6-19  CDR3 amino acids
CARVSSGWSGVTPAPATLTT

SEQ ID NO: 251 - protein, 15 aa, Homo sapiens
  IGHD6-19  CDR3 amino acids
CARRDDSMAGTAMTT

SEQ ID NO: 252 - protein, 16 aa, Homo sapiens
  IGHD6-19  CDR3 amino acids
CARGYSSGFGDAFDTW

SEQ ID NO: 253 - protein, 20 aa, Homo sapiens
  IGHD6-19  CDR3 amino acids
CARGIRYSSGWYGSNWFDPW

SEQ ID NO: 254 - protein, 15 aa, Homo sapiens
  IGHD6-19  CDR3 amino acids
CARRDDSSGWYGHDY

SEQ ID NO: 255 - protein, 15 aa, Homo sapiens
  IGHD6-19  CDR3 amino acids
CARRDDSSAGTAMTT

SEQ ID NO: 256 - protein, 14 aa, Homo sapiens
  IGHD6-19  CDR3 amino acids
CARHGIAWPTTLTT

SEQ ID NO: 257 - protein, 14 aa, Homo sapiens
  IGHD6-19  CDR3 amino acids
CARHVGSGWVTLTT

SEQ ID NO: 258 - protein, 14 aa, Homo sapiens
  IGHD6-19  CDR3 amino acids
CARHGIAVAYYLTT

SEQ ID NO: 259 - protein, 20 aa, Homo sapiens
  IGHD5-5  CDR3 amino acids
CARAGGYSYGYLLPLMLLIS

SEQ ID NO: 260 - protein, 20 aa, Homo sapiens
  IGHD5-5  CDR3 amino acids
CARRKRELLWVTTTTTTWTS

SEQ ID NO: 261 - protein, 12 aa, Homo sapiens
  IGHD5-5  CDR3 amino acids
CARQKSATVWTS

SEQ ID NO: 262 - protein, 22 aa, Homo sapiens
  IGHD5-5  CDR3 amino acids
CARVNLEQLWYRRGTTTTVWTS

SEQ ID NO: 263 - protein, 22 aa, Homo sapiens
  IGHD5-5  CDR3 amino acids
CARVNLEQLCTGRGTTTTVWTS

SEQ ID NO: 264 - protein, 20 aa, Homo sapiens
  IGHD5-5  CDR3 amino acids
CARFYNRRMLSTAMVDIDYW

SEQ ID NO: 265 - protein, 23 aa, Homo sapiens
  IGHD5-5  CDR3 amino acids
CARVNLEQLWYRTGYYYYGMDVW

SEQ ID NO: 266 - protein, 16 aa, Homo sapiens
  IGHD5-5  CDR3 amino acids
CARLFNYAREYGMDVW

SEQ ID NO: 267 - protein, 22 aa, Homo sapiens
  IGHD5-5  CDR3 amino acids
CARVNLEQLWYRTGSTTTVWTS

SEQ ID NO: 268 - protein, 10 aa, Homo sapiens
  IGHD5-5  CDR3 amino acids
CARVAPRLTT

SEQ ID NO: 269 - protein, 16 aa, Homo sapiens
  IGHD5-5  CDR3 amino acids
CARLFNYARGVRVWTS

SEQ ID NO: 270 - protein, 15 aa, Homo sapiens
  IGHD1-26  CDR3 amino acids
CARHVGSGWVYFDYW

SEQ ID NO: 271 - protein, 18 aa, Homo sapiens
  IGHD1-26  CDR3 amino acids
CARAQYSGATECKGTLTT

SEQ ID NO: 272 - protein, 18 aa, Homo sapiens
  IGHD1-26  CDR3 amino acids
CARHSLTPGFLLNYFDYW

SEQ ID NO: 273 - protein, 19 aa, Homo sapiens
  IGHD1-26  CDR3 amino acids
CTRSRGLSGTYYNPDNDYW

SEQ ID NO: 274 - protein, 19 aa, Homo sapiens
  IGHD1-26  CDR3 amino acids
CARAQYSGSYRMQRYFDYW

SEQ ID NO: 275 - protein, 17 aa, Homo sapiens
  IGHD1-26  CDR3 amino acids
CARHVKVLGATVGFDYW

SEQ ID NO: 276 - protein, 18 aa, Homo sapiens
  IGHD1-26  CDR3 amino acids
CARAQYSGSYRCKGTLTT

SEQ ID NO: 277 - protein, 18 aa, Homo sapiens
  IGHD1-26  CDR3 amino acids
CTRSRGLSGTTTIQIMTT

SEQ ID NO: 278 - protein, 18 aa, Homo sapiens
  IGHD1-26  CDR3 amino acids
CARPSIVGATECKGTLTT

SEQ ID NO: 279 - protein, 14 aa, Homo sapiens
  IGHD1-26  CDR3 amino acids
CARHVAVAGSTLTT

SEQ ID NO: 280 - protein, 18 aa, Homo sapiens
  IGHD1-26  CDR3 amino acids
CARAQYSGSYRMQRYLTT

SEQ ID NO: 281 - protein, 18 aa, Homo sapiens
  IGHD1-26  CDR3 amino acids
CARAQYSGSYRMQGTLTT

SEQ ID NO: 282 - protein, 12 aa, Homo sapiens
  IGHD1-26  CDR3 amino acids
CAHTHRSVGATA

SEQ ID NO: 283 - protein, 25 aa, Homo sapiens
  IGHD6-13  CDR3 amino acids
CAKVTHAYSSTWYHGDYYYYGMDVW

SEQ ID NO: 284 - protein, 20 aa, Homo sapiens
  IGHD6-13  CDR3 amino acids
CARGHLPYSSTDKGHWFDPW

SEQ ID NO: 285 - protein, 17 aa, Homo sapiens
  IGHD6-13  CDR3 amino acids
CARDSSHGYSSSWPDYW

SEQ ID NO: 286 - protein, 24 aa, Homo sapiens
  IGHD6-13  CDR3 amino acids
CAKLPMRIAAPGTMGTTTTTVWTS

SEQ ID NO: 287 - protein, 16 aa, Homo sapiens
  IGHD6-13  CDR3 amino acids
CARDSSTGIAAAGPTT

SEQ ID NO: 288 - protein, 17 aa, Homo sapiens
  IGHD2-15  CDR3 amino acids
CLASRPLWFGDPNGSTP

SEQ ID NO: 289 - protein, 20 aa, Homo sapiens
  IGHD2-15  CDR3 amino acids
CAKDSSRYCSGGSCKYFDYW

SEQ ID NO: 290 - protein, 16 aa, Homo sapiens
  IGHD2-15  CDR3 amino acids
CAKNPASTGYGSFDYW

SEQ ID NO: 291 - protein, 15 aa, Homo sapiens
  IGHD2-15  CDR3 amino acids
CAKIRPVLVTEALTI

SEQ ID NO: 292 - protein, 19 aa, Homo sapiens
  IGHD2-15  CDR3 amino acids
CAKDSSRYCMVVAANTLTT

SEQ ID NO: 293 - protein, 17 aa, Homo sapiens
  IGHD2-15  CDR3 amino acids
CARLILGYCSGVGCTPT

SEQ ID NO: 294 - protein, 16 aa, Homo sapiens
  IGHD2-15  CDR3 amino acids
CARDRGSGGSCYVLTT

SEQ ID NO: 295 - protein, 15 aa, Homo sapiens
  IGHD2-15  CDR3 amino acids
CARDGVVVVLLLLTT

SEQ ID NO: 296 - protein, 19 aa, Homo sapiens
  IGHD2-15  CDR3 amino acids
CANWARVVVASGTTTTWTS

SEQ ID NO: 297 - protein, 15 aa, Homo sapiens
  IGHD2-15  CDR3 amino acids
CAKNPPVLVTEALTI

SEQ ID NO: 298 - protein, 15 aa, Homo sapiens
  IGHD2-15  CDR3 amino acids
CAKNPAVLVTEALTI

SEQ ID NO: 299 - protein, 21 aa, Homo sapiens
  IGHD3-3  CDR3 amino acids
CASKKKFLEWPETTTTTVWTS

SEQ ID NO: 300 - protein, 20 aa, Homo sapiens
  IGHD3-3  CDR3 amino acids
CARKEFLEWPETTTTTVWTS

SEQ ID NO: 301 - protein, 25 aa, Homo sapiens
  IGHD3-3  CDR3 amino acids
CAKDINPDYDFWSGSHLPYDAFDIW

SEQ ID NO: 302 - protein, 21 aa, Homo sapiens
  IGHD3-3  CDR3 amino acids
CARKKNFLEWPETTTTTVWTS

SEQ ID NO: 303 - protein, 24 aa, Homo sapiens
  IGHD3-3  CDR3 amino acids
CAKDINPDYDFWSGSHLPYDALIS

SEQ ID NO: 304 - protein, 24 aa, Homo sapiens
  IGHD2-2  CDR3 amino acids
CARDARYCSSTSCYSFPYWYFDLW

SEQ ID NO: 305 - protein, 23 aa, Homo sapiens
  IGHD2-2  CDR3 amino acids
CARDARYCSSTSCYSFPTGTSIS

SEQ ID NO: 306 - protein, 24 aa, Homo sapiens
  IGHD2-2  CDR3 amino acids
CARDARYCSSTSCYRFPYWYFDLW

SEQ ID NO: 307 - protein, 17 aa, Homo sapiens
  IGHD5-12  CDR3 amino acids
CARRLGRVATTYYMDVW

SEQ ID NO: 308 - protein, 16 aa, Homo sapiens
  IGHD5-12  CDR3 amino acids
CARRLVEWLRPTTWTS

SEQ ID NO: 309 - protein, 17 aa, Homo sapiens
  IGHD5-12  CDR3 amino acids
CARRVGVEWLRPTTWTS

SEQ ID NO: 310 - protein, 18 aa, Homo sapiens
  IGHD2-8  CDR3 amino acids
CTRDIVLTTPREWYFDLW

SEQ ID NO: 311 - protein, 17 aa, Homo sapiens
  IGHD2-8  CDR3 amino acids
CTRDIVLTTPGSGTSIS

SEQ ID NO: 312 - protein, 17 aa, Homo sapiens
  IGHD4-17  CDR3 amino acids
CARDLIYGDYPTTTWTS

SEQ ID NO: 313 - protein, 15 aa, Homo sapiens
  IgD  CDR3 amino acids
CARGAAPGVETGSTP

SEQ ID NO: 314 - protein, 26 aa, Homo sapiens
  IgD  CDR3 amino acids
CARHTLFSDSSAPPRGVYYYYYMDVW

SEQ ID NO: 315 - protein, 15 aa, Homo sapiens
  IgD  CDR3 amino acids
CARGATVGVETGSTP

SEQ ID NO: 316 - protein, 15 aa, Homo sapiens
  IgD  CDR3 amino acids
CANWAGVTGTVPLTT

SEQ ID NO: 317 - protein, 12 aa, Homo sapiens
  IgD  CDR3 amino acids
CARQKSATVWTS

SEQ ID NO: 318 - protein, 15 aa, Homo sapiens
  IgD  CDR3 amino acids
CARAGIQLEVFTLTT

SEQ ID NO: 319 - protein, 16 aa, Homo sapiens
  IgD  CDR3 amino acids
CARLDGSGGRGTALTT

SEQ ID NO: 320 - protein, 20 aa, Homo sapiens
  IgD  CDR3 amino acids
CARRKRELLWVTTTTTTWTS

SEQ ID NO: 321 - protein, 15 aa, Homo sapiens
  IgD  CDR3 amino acids
CANPDLISAMFDDYW

SEQ ID NO: 322 - protein, 20 aa, Homo sapiens
  IgD  CDR3 amino acids
CARHQCSGEACFYYYGMDVW

SEQ ID NO: 323 - protein, 14 aa, Homo sapiens
  IgD  CDR3 amino acids
CANPTSFRQCSMTT

SEQ ID NO: 324 - protein, 13 aa, Homo sapiens
  IgD  CDR3 amino acids
CARGGTIPFPWTS

SEQ ID NO: 325 - protein, 14 aa, Homo sapiens
  IgD  CDR3 amino acids
CARAQGGAHTTLTT

SEQ ID NO: 326 - protein, 15 aa, Homo sapiens
  IgD  CDR3 amino acids
CTRDTGSSAGATDLW

SEQ ID NO: 327 - protein, 15 aa, Homo sapiens
  IgD  CDR3 amino acids
CAKAVAVTGSHFDYW

SEQ ID NO: 328 - protein, 15 aa, Homo sapiens
  IgD  CDR3 amino acids
CARGAAPGVETGSTL

SEQ ID NO: 329 - protein, 15 aa, Homo sapiens
  IgD  CDR3 amino acids
CARAQGRGTYYFDYW

SEQ ID NO: 330 - protein, 11 aa, Homo sapiens
  IgD  CDR3 amino acids
CARAIIRYFND

SEQ ID NO: 331 - protein, 15 aa, Homo sapiens
  IgD  CDR3 amino acids
CAIPPDGSRRSPLTT

SEQ ID NO: 332 - protein, 18 aa, Homo sapiens
  IgD  CDR3 amino acids
CVREGFCGAHGCYSLTYW

SEQ ID NO: 333 - protein, 25 aa, Homo sapiens
  IgD  CDR3 amino acids
CARHTLFSDSSAPPRGSTTTTTWTS

SEQ ID NO: 334 - protein, 15 aa, Homo sapiens
  IgD  CDR3 amino acids
CARGYSSASVMLLIP

SEQ ID NO: 335 - protein, 17 aa, Homo sapiens
  IgD  CDR3 amino acids
CVREGFVVLMAVILLPT

SEQ ID NO: 336 - protein, 11 aa, Homo sapiens
  IgD  CDR3 amino acids
CARSGPRGLTT

SEQ ID NO: 337 - protein, 18 aa, Homo sapiens
  IgD  CDR3 amino acids
CARHSLTPGFLLNYFDYW

SEQ ID NO: 338 - protein, 10 aa, Homo sapiens
  IgD  CDR3 amino acids
CARGWELDRW

SEQ ID NO: 339 - protein, 18 aa, Homo sapiens
  IgD  CDR3 amino acids
CARDPSSLYYYYYGMDVW

SEQ ID NO: 340 - protein, 11 aa, Homo sapiens
  IgD  CDR3 amino acids
CARAIIHISMT

SEQ ID NO: 341 - protein, 14 aa, Homo sapiens
  IgD  CDR3 amino acids
CANPDSFRQCSMTT

SEQ ID NO: 342 - protein, 15 aa, Homo sapiens
  IgD  CDR3 amino acids
CAIPRTEGRRSPLTT

SEQ ID NO: 343 - protein, 13 aa, Homo sapiens
  IgD  CDR3 amino acids
CARTFGDSAALIS

SEQ ID NO: 344 - protein, 16 aa, Homo sapiens
  IgD  CDR3 amino acids
CARLFNYAREYGMDVW

SEQ ID NO: 345 - protein, 26 aa, Homo sapiens
  IgD  CDR3 amino acids
CARHTLFSDSSAPPTGGLLLLLHGRL

SEQ ID NO: 346 - protein, 25 aa, Homo sapiens
  IgD  CDR3 amino acids
CARHTLFRIVVPLPGGSTTTTTWTS

SEQ ID NO: 347 - protein, 15 aa, Homo sapiens
  IgD  CDR3 amino acids
CARDLGESSSTTLTT

SEQ ID NO: 348 - protein, 12 aa, Homo sapiens
  IgD  CDR3 amino acids
CARAIIRYFNDW

SEQ ID NO: 349 - protein, 16 aa, Homo sapiens
  IgD  CDR3 amino acids
CAPGGLRLGVETGSTP

SEQ ID NO: 350 - protein, 20 aa, Homo sapiens
  IgD  CDR3 amino acids
CARTLDYGIATGSIIMVWTS

SEQ ID NO: 351 - protein, 16 aa, Homo sapiens
  IgD  CDR3 amino acids
CARRLGRVARPTTWTS

SEQ ID NO: 352 - protein, 15 aa, Homo sapiens
  IgD  CDR3 amino acids
CARLFNTPGSTVWTS

SEQ ID NO: 353 - protein, 15 aa, Homo sapiens
  IgD  CDR3 amino acids
CAIPPTEGRRSPLTT

SEQ ID NO: 354 - protein, 16 aa, Homo sapiens
  IgD  CDR3 amino acids
CAIPPDGRQTVPFDYW

SEQ ID NO: 355 - protein, 14 aa, Homo sapiens
  IgD  CDR3 amino acids
CTRDTGSPPEPLTS

SEQ ID NO: 356 - protein, 11 aa, Homo sapiens
  IgD  CDR3 amino acids
CATSRGGRGTT

SEQ ID NO: 357 - protein, 10 aa, Homo sapiens
  IgD  CDR3 amino acids
CATSGGVGDY

SEQ ID NO: 358 - protein, 14 aa, Homo sapiens
  IgD  CDR3 amino acids
CATPTSFRQCSMTT

SEQ ID NO: 359 - protein, 16 aa, Homo sapiens
  IgD  CDR3 amino acids
CATAAGLWSSSTTWTS

SEQ ID NO: 360 - protein, 17 aa, Homo sapiens
  IgD  CDR3 amino acids
CATAAGLWSSKYYMDVW

SEQ ID NO: 361 - protein, 12 aa, Homo sapiens
  IgD  CDR3 amino acids
CASKKSATVWTS

SEQ ID NO: 362 - protein, 13 aa, Homo sapiens
  IgD  CDR3 amino acids
CARVGSSTMLLIS

SEQ ID NO: 363 - protein, 13 aa, Homo sapiens
  IgD  CDR3 amino acids
CARVGSSPMLLIS

SEQ ID NO: 364 - protein, 13 aa, Homo sapiens
  IgD  CDR3 amino acids
CARVAARPMLLIS

SEQ ID NO: 365 - protein, 13 aa, Homo sapiens
  IgD  CDR3 amino acids
CARTFVIRLLLIS

SEQ ID NO: 366 - protein, 16 aa, Homo sapiens
  IgD  CDR3 amino acids
CARRLGRVLRPTTWTS

SEQ ID NO: 367 - protein, 21 aa, Homo sapiens
  IgD  CDR3 amino acids
CARRKKGSCYRVTTTTTTWTS

SEQ ID NO: 368 - protein, 15 aa, Homo sapiens
  IgD  CDR3 amino acids
CARLFNYARSTVWTS

SEQ ID NO: 369 - protein, 14 aa, Homo sapiens
  IgD  CDR3 amino acids
CARHVGMAGSTLTT

SEQ ID NO: 370 - protein, 26 aa, Homo sapiens
  IgD  CDR3 amino acids
CARHTLFSDSSAPPRGGLLLLLHGRL

SEQ ID NO: 371 - protein, 26 aa, Homo sapiens
  IgD  CDR3 amino acids
CARHTLFSDSSALPRGVYYYYYMDVW

SEQ ID NO: 372 - protein, 25 aa, Homo sapiens
  IgD  CDR3 amino acids
CARHTLFSDSSALPGGSTTTTTWTS

SEQ ID NO: 373 - protein, 19 aa, Homo sapiens
  IgD  CDR3 amino acids
CARHQCSGEACFYYTAWTS

SEQ ID NO: 374 - protein, 15 aa, Homo sapiens
  IgD  CDR3 amino acids
CARGYSMASVMLLIP

SEQ ID NO: 375 - protein, 9 aa, Homo sapiens
  IgD  CDR3 amino acids
CARGWELDR

SEQ ID NO: 376 - protein, 15 aa, Homo sapiens
  IgD  CDR3 amino acids
CARGQMGATTLIDYW

SEQ ID NO: 377 - protein, 13 aa, Homo sapiens
  IgD  CDR3 amino acids
CAREWPTGTRGMW

SEQ ID NO: 378 - protein, 13 aa, Homo sapiens
  IgD  CDR3 amino acids
CAREWPTGTRGMC

SEQ ID NO: 379 - protein, 14 aa, Homo sapiens
  IgD  CDR3 amino acids
CAREWPTGNQRGCG

SEQ ID NO: 380 - protein, 9 aa, Homo sapiens
  IgD  CDR3 amino acids
CARDSTQTT

SEQ ID NO: 381 - protein, 18 aa, Homo sapiens
  IgD  CDR3 amino acids
CARAQYGGATECKGTLTT

SEQ ID NO: 382 - protein, 15 aa, Homo sapiens
  IgD  CDR3 amino acids
CARAQGAGAHTTLTT

SEQ ID NO: 383 - protein, 11 aa, Homo sapiens
  IgD  CDR3 amino acids
CARAKYDISMT

SEQ ID NO: 384 - protein, 11 aa, Homo sapiens
  IgD  CDR3 amino acids
CARAIYDISMT

SEQ ID NO: 385 - protein, 11 aa, Homo sapiens
  IgD  CDR3 amino acids
CARAIIRYSMT

SEQ ID NO: 386 - protein, 15 aa, Homo sapiens
  IgD  CDR3 amino acids
CARAHGAGAHTTLTT

SEQ ID NO: 387 - protein, 15 aa, Homo sapiens
  IgD  CDR3 amino acids
CANWPGVTGTVPLTT

SEQ ID NO: 388 - protein, 12 aa, Homo sapiens
  IgD  CDR3 amino acids
CAKRWGSSSWTT

SEQ ID NO: 389 - protein, 15 aa, Homo sapiens
  IgD  CDR3 amino acids
CAKIRPVLVTEALTI

SEQ ID NO: 390 - protein, 17 aa, Homo sapiens
  IgD  CDR3 amino acids
CAKDLHSYGYLGAFDIW

SEQ ID NO: 391 - protein, 15 aa, Homo sapiens
  IgD  CDR3 amino acids
CAIPPDGRQTSPLTT

SEQ ID NO: 392 - protein, 15 aa, Homo sapiens
  IgD  CDR3 amino acids
CAIPPDGRQTAPLTT

SEQ ID NO: 393 - protein, 12 aa, Homo sapiens
  IgD  CDR3 amino acids
CAHTHRSVGALP

SEQ ID NO: 394 - protein, 10 aa, Homo sapiens
  IgD  CDR3 amino acids
CAGVAPRLTT

SEQ ID NO: 395 - protein, 12 aa, Homo sapiens
  IGHD4-17  CDR3 amino acids
CARGFDGGWEHW

SEQ ID NO: 396 - protein, 13 aa, Homo sapiens
  IGHD4-17  CDR3 amino acids
CARGFLMVAGEHW

SEQ ID NO: 397 - protein, 12 aa, Homo sapiens
  IGHD4-17  CDR3 amino acids
CARGFLMVAGST

SEQ ID NO: 398 - protein, 12 aa, Homo sapiens
  IGHD4-17  CDR3 amino acids
CARGFDGGWGAL

SEQ ID NO: 399 - protein, 11 aa, Homo sapiens
  IGHD4-17  CDR3 amino acids
CARGFDGGWEH

SEQ ID NO: 400 - protein, 11 aa, Homo sapiens
  IGHD4-17  CDR3 amino acids
CARGFDGAGST

SEQ ID NO: 401 - protein, 12 aa, Homo sapiens
  IGHD4-17  CDR3 amino acids
CARGFDGGWEYW

SEQ ID NO: 402 - protein, 12 aa, Homo sapiens
  IGHD4-17  CDR3 amino acids
CARGFDGGWEHR

SEQ ID NO: 403 - protein, 12 aa, Homo sapiens
  IGHD4-17  CDR3 amino acids
CAGGFDGGWEHW

SEQ ID NO: 404 - protein, 11 aa, Homo sapiens
  IGHD4-17  CDR3 amino acids
CARGLMVAGST

SEQ ID NO: 405 - protein, 11 aa, Homo sapiens
  IGHD4-17  CDR3 amino acids
CARGFDGGWST

SEQ ID NO: 406 - protein, 12 aa, Homo sapiens
  IGHD4-17  CDR3 amino acids
CARGFDGGREHW

SEQ ID NO: 407 - protein, 12 aa, Homo sapiens
  IGHD4-17  CDR3 amino acids
CVRGFDGGWEHW

SEQ ID NO: 408 - protein, 12 aa, Homo sapiens
  IGHD4-17  CDR3 amino acids
CARGLDGGWEHW

SEQ ID NO: 409 - protein, 12 aa, Homo sapiens
  IGHD4-17  CDR3 amino acids
CARGFDGGWGHW

SEQ ID NO: 410 - protein, 13 aa, Homo sapiens
  IGHD4-17  CDR3 amino acids
CARGFDGGWGALG

SEQ ID NO: 411 - protein, 12 aa, Homo sapiens
  IGHD4-17  CDR3 amino acids
CARGFDGAGEHW

SEQ ID NO: 412 - protein, 12 aa, Homo sapiens
  IGHD4-17  CDR3 amino acids
CARGSDGGWEHW

SEQ ID NO: 413 - protein, 12 aa, Homo sapiens
  IGHD4-17  CDR3 amino acids
CARGFGGGWEHW

SEQ ID NO: 414 - protein, 12 aa, Homo sapiens
  IGHD4-17  CDR3 amino acids
CARGFDGSWEHW

SEQ ID NO: 415 - protein, 12 aa, Homo sapiens
  IGHD4-17  CDR3 amino acids
CARGFDGGWERW

SEQ ID NO: 416 - protein, 12 aa, Homo sapiens
  IGHD4-17  CDR3 amino acids
CARGFDDGWEHW

SEQ ID NO: 417 - protein, 12 aa, Homo sapiens
  IGHD4-17  CDR3 amino acids
YARGFDGGWEHW

SEQ ID NO: 418 - protein, 12 aa, Homo sapiens
  IGHD4-17  CDR3 amino acids
CARGFDGGWKHW

SEQ ID NO: 419 - protein, 12 aa, Homo sapiens
  IGHD4-17  CDR3 amino acids
CARGFDGGSGAL

SEQ ID NO: 420 - protein, 12 aa, Homo sapiens
  IGHD4-17  CDR3 amino acids
CARGFVWWLGGT

SEQ ID NO: 421 - protein, 12 aa, Homo sapiens
  IGHD4-17  CDR3 amino acids
CARGFDSGWEHW

SEQ ID NO: 422 - protein, 12 aa, Homo sapiens
  IGHD4-17  CDR3 amino acids
CARGFDRWLGAL

SEQ ID NO: 423 - protein, 12 aa, Homo sapiens
  IGHD4-17  CDR3 amino acids
CARGFDGGWVHW

SEQ ID NO: 424 - protein, 12 aa, Homo sapiens
  IGHD4-17  CDR3 amino acids
CARGFDGGWEAL

SEQ ID NO: 425 - protein, 12 aa, Homo sapiens
  IGHD4-17  CDR3 amino acids
CARGFDGDWEHW

SEQ ID NO: 426 - protein, 11 aa, Homo sapiens
  IGHD4-17  CDR3 amino acids
CARGFDGAGSM

SEQ ID NO: 427 - protein, 12 aa, Homo sapiens
  IGHD4-17  CDR3 amino acids
CARSFDGGWEHW

SEQ ID NO: 428 - protein, 13 aa, Homo sapiens
  IGHD4-17  CDR3 amino acids
CARGFLMVAGEHG

SEQ ID NO: 429 - protein, 12 aa, Homo sapiens
  IGHD4-17  CDR3 amino acids
CARGFLMVAGEH

SEQ ID NO: 430 - protein, 11 aa, Homo sapiens
  IGHD4-17  CDR3 amino acids
CARGFDVAGST

SEQ ID NO: 431 - protein, 12 aa, Homo sapiens
  IGHD4-17  CDR3 amino acids
CARGFDGGWEHS

SEQ ID NO: 432 - protein, 12 aa, Homo sapiens
  IGHD4-17  CDR3 amino acids
CARGFDGGWEHG

SEQ ID NO: 433 - protein, 12 aa, Homo sapiens
  IGHD4-17  CDR3 amino acids
CARGFDGGCEHW

SEQ ID NO: 434 - protein, 11 aa, Homo sapiens
  IGHD4-17  CDR3 amino acids
CARGFDGAGEH

SEQ ID NO: 435 - protein, 12 aa, Homo sapiens
  IGHD1-7  CDR3 amino acids
CARGFDGGWEHW

SEQ ID NO: 436 - protein, 12 aa, Homo sapiens
  IgE  CDR3 amino acids
CARGFDGGWEHW

SEQ ID NO: 437 - protein, 13 aa, Homo sapiens
  IgE  CDR3 amino acids
CARGFLMVAGEHW

SEQ ID NO: 438 - protein, 12 aa, Homo sapiens
  IgE  CDR3 amino acids
CARGFDGGWEHS

SEQ ID NO: 439 - protein, 12 aa, Homo sapiens
  IgE  CDR3 amino acids
CARGFLMVAGST

SEQ ID NO: 440 - protein, 12 aa, Homo sapiens
  IgE  CDR3 amino acids
CARGFVWWLGGT

SEQ ID NO: 441 - protein, 13 aa, Homo sapiens
  IgE  CDR3 amino acids
CARGFLMVAGSTG

SEQ ID NO: 442 - protein, 12 aa, Homo sapiens
  IgE  CDR3 amino acids
CARGFDGGSGAL

SEQ ID NO: 443 - protein, 11 aa, Homo sapiens
  IgE  CDR3 amino acids
CARGFDGAGST

SEQ ID NO: 444 - protein, 17 aa, Homo sapiens
  IGHD3-10  CDR3 amino acids
CARGRYAGGVIITALTP

SEQ ID NO: 445 - protein, 15 aa, Homo sapiens
  IGHD3-10  CDR3 amino acids
CARLPRMVRGNWFHP

SEQ ID NO: 446 - protein, 19 aa, Homo sapiens
  IGHD3-10  CDR3 amino acids
CARGAWAVRGVISWAGSTP

SEQ ID NO: 447 - protein, 21 aa, Homo sapiens
  IGHD3-10  CDR3 amino acids
CSREVGRDYYGSGVIEITWTS

SEQ ID NO: 448 - protein, 16 aa, Homo sapiens
  IGHD3-10  CDR3 amino acids
CAGSGSGSLLTTVWTP

SEQ ID NO: 449 - protein, 22 aa, Homo sapiens
  IGHD3-10  CDR3 amino acids
CSREVGRDYYGSGSYRNYMDVW

SEQ ID NO: 450 - protein, 20 aa, Homo sapiens
  IGHD3-10  CDR3 amino acids
CVSITNSLLWFGELLIFDCW

SEQ ID NO: 451 - protein, 20 aa, Homo sapiens
  IGHD3-22  CDR3 amino acids
CAKITSMIVVLIPTMMLLMS

SEQ ID NO: 452 - protein, 22 aa, Homo sapiens
  IGHD3-22  CDR3 amino acids
CARGSRARFSSDTSGYQYFDYW

SEQ ID NO: 453 - protein, 19 aa, Homo sapiens
  IGHD3-22  CDR3 amino acids
CARGVYLYYDSHAYSVLTT

SEQ ID NO: 454 - protein, 14 aa, Homo sapiens
  IGHD3-22  CDR3 amino acids
CARVNYYDSVVLTT

SEQ ID NO: 455 - protein, 15 aa, Homo sapiens
  IGHD3-22  CDR3 amino acids
CARVNYYDSSRIDYW

SEQ ID NO: 456 - protein, 21 aa, Homo sapiens
  IGHD3-22  CDR3 amino acids
CARLPPFNNDDSSSYALYLTT

SEQ ID NO: 457 - protein, 23 aa, Homo sapiens
  IGHD3-22  CDR3 amino acids
CARHSNYYYDTSGYRVLDAFDIW

SEQ ID NO: 458 - protein, 20 aa, Homo sapiens
  IGHD3-22  CDR3 amino acids
CARGGMDSYGYFYVGHYDYW

SEQ ID NO: 459 - protein, 7 aa, Homo sapiens
  IGHD3-22  CDR3 amino acids
CARDPDF

SEQ ID NO: 460 - protein, 20 aa, Homo sapiens
  IGHD3-22  CDR3 amino acids
CAKITSMIVVLTPTMMLLMS

SEQ ID NO: 461 - protein, 18 aa, Homo sapiens
  IGHD6-13  CDR3 amino acids
CTRQEESSAAGTGGTSSP

SEQ ID NO: 462 - protein, 16 aa, Homo sapiens
  IGHD6-13  CDR3 amino acids
CALCPTPIAAAGSVTT

SEQ ID NO: 463 - protein, 21 aa, Homo sapiens
  IGHD6-13  CDR3 amino acids
CATSEGDPVAAAGTKSWFDSW

SEQ ID NO: 464 - protein, 19 aa, Homo sapiens
  IGHD6-13  CDR3 amino acids
CARLALLYGSSRYGATLTT

SEQ ID NO: 465 - protein, 15 aa, Homo sapiens
  IGHD6-13  CDR3 amino acids
CARGPSSTWYSFDYW

SEQ ID NO: 466 - protein, 20 aa, Homo sapiens
  IGHD2-15  CDR3 amino acids
CAKKEFILVVVITMMSLLMS

SEQ ID NO: 467 - protein, 14 aa, Homo sapiens
  IGHD2-15  CDR3 amino acids
CAKDMTAKACSDYW

SEQ ID NO: 468 - protein, 20 aa, Homo sapiens
  IGHD2-15  CDR3 amino acids
CARVMGCRGGRCDFRAFDIW

SEQ ID NO: 469 - protein, 16 aa, Homo sapiens
  IGHD2-15  CDR3 amino acids
CARRFCSGGICYFLTT

SEQ ID NO: 470 - protein, 18 aa, Homo sapiens
  IGHD2-15  CDR3 amino acids
CALTGLNGRSCYSELLIS

SEQ ID NO: 471 - protein, 21 aa, Homo sapiens
  IGHD2-15  CDR3 amino acids
CAKEGVYFSGGNHYDVAFNVW

SEQ ID NO: 472 - protein, 17 aa, Homo sapiens
  IGHD3-3  CDR3 amino acids
CARPSRCCYSGGGRLTL

SEQ ID NO: 473 - protein, 23 aa, Homo sapiens
  IGHD3-3  CDR3 amino acids
CAHSVGFILDFWSGYQNNWFDPW

SEQ ID NO: 474 - protein, 17 aa, Homo sapiens
  IGHD3-3  CDR3 amino acids
CARPSRCCYVRGGRLTL

SEQ ID NO: 475 - protein, 18 aa, Homo sapiens
  IGHD3-3  CDR3 amino acids
CAMGPTIFGVVFLGSLTS

SEQ ID NO: 476 - protein, 23 aa, Homo sapiens
  IGHD3-3  CDR3 amino acids
CAHSVGFILDFWSGYQNNWFDPG

SEQ ID NO: 477 - protein, 22 aa, Homo sapiens
  IGHD3-3  CDR3 amino acids
CAHSVGFILDFGVVIRTTGSTP

SEQ ID NO: 478 - protein, 15 aa, Homo sapiens
  IGHD6-25  CDR3 amino acids
CARVKGGIAGMAWTS

SEQ ID NO: 479 - protein, 17 aa, Homo sapiens
  IGHD5-5  CDR3 amino acids
CARGVDTTMVRSTTLTT

SEQ ID NO: 480 - protein, 23 aa, Homo sapiens
  IGHD5-5  CDR3 amino acids
CARQDPYCSTSNCTMGGAMTLTT

SEQ ID NO: 481 - protein, 19 aa, Homo sapiens
  IGHD5-24  CDR3 amino acids
CARTDGIRDGYNLHRVLTT

SEQ ID NO: 482 - protein, 20 aa, Homo sapiens
  IGHD5-24  CDR3 amino acids
CARTDAIRDGYNLHRVFDYW

SEQ ID NO: 483 - protein, 18 aa, Homo sapiens
  IGHD5-24  CDR3 amino acids
CARGKRDAYNYYSHLDSW

SEQ ID NO: 484 - protein, 17 aa, Homo sapiens
  IGHD5-24  CDR3 amino acids
CARGKEMPTITTLILTP

SEQ ID NO: 485 - protein, 21 aa, Homo sapiens
  IGHD3-16  CDR3 amino acids
CVRQSPLDDVWGVFAPVGSTP

SEQ ID NO: 486 - protein, 21 aa, Homo sapiens
  IGHD3-16  CDR3 amino acids
CVRQSPLDDVWGVFAPVGSTL

SEQ ID NO: 487 - protein, 15 aa, Homo sapiens
  IGHD4-17  CDR3 amino acids
CARHPKPPTVTSATT

SEQ ID NO: 488 - protein, 15 aa, Homo sapiens
  IGHD4-17  CDR3 amino acids
CAKGENTVTTGQEYW

SEQ ID NO: 489 - protein, 14 aa, Homo sapiens
  IGHD4-17  CDR3 amino acids
CAKGENTVTTGQEY

SEQ ID NO: 490 - protein, 20 aa, Homo sapiens
  IGHD3-9  CDR3 amino acids
CAREGRNYDSLTGDPWFDPW

SEQ ID NO: 491 - protein, 23 aa, Homo sapiens
  IGHD2-2  CDR3 amino acids
CASRYCTSDRCLGASGKPSFDTW

SEQ ID NO: 492 - protein, 20 aa, Homo sapiens
  IGHD2-2  CDR3 amino acids
CARHSLAYCSTTSCAVFDYW

SEQ ID NO: 493 - protein, 27 aa, Homo sapiens
  IGHD2-2  CDR3 amino acids
CARHGFEGREVVPPAMNEYYYYYMDVW

SEQ ID NO: 494 - protein, 23 aa, Homo sapiens
  IGHD1-7  CDR3 amino acids
CARGDCTTINCNTHSDYYGLDVW

SEQ ID NO: 495 - protein, 16 aa, Homo sapiens
  IGHD1-7  CDR3 amino acids
CARTVGTGTTNGYLTS

SEQ ID NO: 496 - protein, 22 aa, Homo sapiens
  IGHD1-7  CDR3 amino acids
CAREIVLLSTATLTPTTTVWTS

SEQ ID NO: 497 - protein, 20 aa, Homo sapiens
  IGHD5-12  CDR3 amino acids
CARQDSGYDYGYYHNGMDVW

SEQ ID NO: 498 - protein, 16 aa, Homo sapiens
  IGHD4-23  CDR3 amino acids
CARGAGYGGNSGVRTT

SEQ ID NO: 499 - protein, 14 aa, Homo sapiens
  IGHD6-19  CDR3 amino acids
CARDLGSGWFRFDP

SEQ ID NO: 500 - protein, 14 aa, Homo sapiens
  IGHD6-19  CDR3 amino acids
CARDLGSGWFGSTP

SEQ ID NO: 501 - protein, 23 aa, Homo sapiens
  IGHD2-8  CDR3 amino acids
CAKSHHCTNGVCHPPRFGQRSTP

SEQ ID NO: 502 - protein, 15 aa, Homo sapiens
  IgG  CDR3 amino acids
CARGATVGVETGSTP

SEQ ID NO: 503 - protein, 13 aa, Homo sapiens
  IgG  CDR3 amino acids
CARKGSRHGGSTP

SEQ ID NO: 504 - protein, 15 aa, Homo sapiens
  IgG  CDR3 amino acids
CARQNGPSIGGGSTP

SEQ ID NO: 505 - protein, 15 aa, Homo sapiens
  IgG  CDR3 amino acids
CARGATPGAETGSTP

SEQ ID NO: 506 - protein, 14 aa, Homo sapiens
  IgG  CDR3 amino acids
CAKDTLGGMGGLTS

SEQ ID NO: 507 - protein, 27 aa, Homo sapiens
  IgG  CDR3 amino acids
CARVRVLPEGVLISLRPLGSTTITWTS

SEQ ID NO: 508 - protein, 17 aa, Homo sapiens
  IgG  CDR3 amino acids
CARGGPKKVVTAAHLSP

SEQ ID NO: 509 - protein, 14 aa, Homo sapiens
  IgG  CDR3 amino acids
CSTLGLGPPGGQTT

SEQ ID NO: 510 - protein, 17 aa, Homo sapiens
  IgG  CDR3 amino acids
CARDHYDTRGVRMLLIS

SEQ ID NO: 511 - protein, 15 aa, Homo sapiens
  IgG  CDR3 amino acids
CATDRDSSWGTSLTT

SEQ ID NO: 512 - protein, 23 aa, Homo sapiens
  IgG  CDR3 amino acids
CARMVRGGGRTSSGYYYYYMDVW

SEQ ID NO: 513 - protein, 15 aa, Homo sapiens
  IgG  CDR3 amino acids
CARDGVWDLPTTLTT

SEQ ID NO: 514 - protein, 19 aa, Homo sapiens
  IgG  CDR3 amino acids
CVRMGPPCQLAGRSSSLTS

SEQ ID NO: 515 - protein, 23 aa, Homo sapiens
  IgG  CDR3 amino acids
CTMATVGHGLRRCFGKSTATLTS

SEQ ID NO: 516 - protein, 16 aa, Homo sapiens
  IgG  CDR3 amino acids
CARRGGSTVTTGTSIS

SEQ ID NO: 517 - protein, 14 aa, Homo sapiens
  IgG  CDR3 amino acids
CSTLGLGPPGGLTT

SEQ ID NO: 518 - protein, 9 aa, Homo sapiens
  IgG  CDR3 amino acids
CMGPGETAI

SEQ ID NO: 519 - protein, 17 aa, Homo sapiens
  IgG  CDR3 amino acids
CARVSMIRFRVWGLWTS

SEQ ID NO: 520 - protein, 14 aa, Homo sapiens
  IgG  CDR3 amino acids
CARVQRGAVVIPTT

SEQ ID NO: 521 - protein, 18 aa, Homo sapiens
  IgG  CDR3 amino acids
CARRRYNDLGAPNWVDPW

SEQ ID NO: 522 - protein, 22 aa, Homo sapiens
  IgG  CDR3 amino acids
CARGEDCGGGRCNNLPTTVWTS

SEQ ID NO: 523 - protein, 17 aa, Homo sapiens
  IgG  CDR3 amino acids
CAKRKLAPPRKFTTLTT

SEQ ID NO: 524 - protein, 22 aa, Homo sapiens
  IgG  CDR3 amino acids
CATLEGGAPPDLRRAEAFLLIS

SEQ ID NO: 525 - protein, 23 aa, Homo sapiens
  IgG  CDR3 amino acids
CARQDPYCSTSNCTMGGAMTLTT

SEQ ID NO: 526 - protein, 23 aa, Homo sapiens
  IgG  CDR3 amino acids
CARGKDCGGGRCNNVPYYGMDVW

SEQ ID NO: 527 - protein, 16 aa, Homo sapiens
  IgG  CDR3 amino acids
CAKDGHKLTGTTTRTS

SEQ ID NO: 528 - protein, 15 aa, Homo sapiens
  IgG  CDR3 amino acids
CAILPETQWYPRLTT

SEQ ID NO: 529 - protein, 15 aa, Homo sapiens
  IgG  CDR3 amino acids
CVRDLGAITPVFSTS

SEQ ID NO: 530 - protein, 13 aa, Homo sapiens
  IgG  CDR3 amino acids
CVHRPRWLNVVPT

SEQ ID NO: 531 - protein, 13 aa, Homo sapiens
  IgG  CDR3 amino acids
CVHRPRWLNVVPN

SEQ ID NO: 532 - protein, 20 aa, Homo sapiens
  IgG  CDR3 amino acids
CARSFVVKVHAHCGAVLSST

SEQ ID NO: 533 - protein, 21 aa, Homo sapiens
  IgG  CDR3 amino acids
CARRLNVAVVVPAYVGWFDPW

SEQ ID NO: 534 - protein, 15 aa, Homo sapiens
  IgG  CDR3 amino acids
CARLGKNHSQGVDYW

SEQ ID NO: 535 - protein, 16 aa, Homo sapiens
  IgG  CDR3 amino acids
CARGPGGVWDRLSLTS

SEQ ID NO: 536 - protein, 22 aa, Homo sapiens
  IgG  CDR3 amino acids
CARGKDCGGGRCNNVPTTGWTS

SEQ ID NO: 537 - protein, 24 aa, Homo sapiens
  IgG  CDR3 amino acids
CARGFMVQASSVRLKRGQFLADSW

SEQ ID NO: 538 - protein, 14 aa, Homo sapiens
  IgG  CDR3 amino acids
CARGDWGTVTLATT

SEQ ID NO: 539 - protein, 16 aa, Homo sapiens
  IgG  CDR3 amino acids
CARDWEWQQRLNYFDP

SEQ ID NO: 540 - protein, 21 aa, Homo sapiens
  IgG  CDR3 amino acids
CARDNQPWRDARNLGGAFDVW

SEQ ID NO: 541 - protein, 22 aa, Homo sapiens
  IgG  CDR3 amino acids
CARDGLRPPPFMVTIQRGGLTT

SEQ ID NO: 542 - protein, 23 aa, Homo sapiens
  IgG  CDR3 amino acids
CARAVGGFNSGWPSIGVPARSTP

SEQ ID NO: 543 - protein, 23 aa, Homo sapiens
  IgG  CDR3 amino acids
CARAVGGFNSGWPSIGVPARSTL

SEQ ID NO: 544 - protein, 17 aa, Homo sapiens
  IgG  CDR3 amino acids
CAKVDETVVLPAALLTP

SEQ ID NO: 545 - protein, 23 aa, Homo sapiens
  IgG  CDR3 amino acids
CAKSPKPWSQLVSTPIMPTPWTS

SEQ ID NO: 546 - protein, 14 aa, Homo sapiens
  IgG  CDR3 amino acids
CVRRAAGGRSGLTT

SEQ ID NO: 547 - protein, 16 aa, Homo sapiens
  IgG  CDR3 amino acids
CVRPPPTVPGTAGSTP

SEQ ID NO: 548 - protein, 13 aa, Homo sapiens
  IgG  CDR3 amino acids
CVRESTFYYFGPW

SEQ ID NO: 549 - protein, 26 aa, Homo sapiens
  IgG  CDR3 amino acids
CVRDDDYSRTWYMGQGASSDYGMDVW

SEQ ID NO: 550 - protein, 14 aa, Homo sapiens
  IgG  CDR3 amino acids
CVKWVSGVLTSLTT

SEQ ID NO: 551 - protein, 12 aa, Homo sapiens
  IgG  CDR3 amino acids
CVALFVPAGSTL

SEQ ID NO: 552 - protein, 24 aa, Homo sapiens
  IgG  CDR3 amino acids
CTMATVGHGATTLFREVHRNTDFW

SEQ ID NO: 553 - protein, 14 aa, Homo sapiens
  IgG  CDR3 amino acids
CSTLGLGPRGADYW

SEQ ID NO: 554 - protein, 11 aa, Homo sapiens
  IgG  CDR3 amino acids
CSRTGGRLLIS

SEQ ID NO: 555 - protein, 12 aa, Homo sapiens
  IgG  CDR3 amino acids
CSKVGRILKLIT

SEQ ID NO: 556 - protein, 11 aa, Homo sapiens
  IgG  CDR3 amino acids
CKVAVEMVLMY

SEQ ID NO: 557 - protein, 12 aa, Homo sapiens
  IgG  CDR3 amino acids
CGKFLGTTVASS

SEQ ID NO: 558 - protein, 18 aa, Homo sapiens
  IgG  CDR3 amino acids
CATSGRSSAWYPDVFDIW

SEQ ID NO: 559 - protein, 18 aa, Homo sapiens
  IgG  CDR3 amino acids
CATNYCRGISCYPAPLTT

SEQ ID NO: 560 - protein, 22 aa, Homo sapiens
  IgG  CDR3 amino acids
CATLTGGAPPDLRRAEAFLLIS

SEQ ID NO: 561 - protein, 14 aa, Homo sapiens
  IgG  CDR3 amino acids
CATEGTGAVTPFTT

SEQ ID NO: 562 - protein, 11 aa, Homo sapiens
  IgG  CDR3 amino acids
CATAPGGTSYT

SEQ ID NO: 563 - protein, 14 aa, Homo sapiens
  IgG  CDR3 amino acids
CASRPSWGSSFDFW

SEQ ID NO: 564 - protein, 13 aa, Homo sapiens
  IgG  CDR3 amino acids
CASRPPGAAALTS

SEQ ID NO: 565 - protein, 13 aa, Homo sapiens
  IgG  CDR3 amino acids
CASMIALHHTLTS

SEQ ID NO: 566 - protein, 15 aa, Homo sapiens
  IgG  CDR3 amino acids
CARYSPVDPSTLDFW

SEQ ID NO: 567 - protein, 16 aa, Homo sapiens
  IgG  CDR3 amino acids
CARVLDSSAHWYFDDW

SEQ ID NO: 568 - protein, 17 aa, Homo sapiens
  IgG  CDR3 amino acids
CARRRYNDLGAPTGSTP

SEQ ID NO: 569 - protein, 15 aa, Homo sapiens
  IgG  CDR3 amino acids
CARQNGPSIGGGSTL

SEQ ID NO: 570 - protein, 18 aa, Homo sapiens
  IgG  CDR3 amino acids
CARQHSEWEILRLVFDHW

SEQ ID NO: 571 - protein, 22 aa, Homo sapiens
  IgG  CDR3 amino acids
CARMVREEAERRPAIIITTWTS

SEQ ID NO: 572 - protein, 15 aa, Homo sapiens
  IgG  CDR3 amino acids
CARLPRMVRVTGSTP

SEQ ID NO: 573 - protein, 15 aa, Homo sapiens
  IgG  CDR3 amino acids
CARIDYVSTWYYDQW

SEQ ID NO: 574 - protein, 16 aa, Homo sapiens
  IgG  CDR3 amino acids
CARICAEREFLSLLTP

SEQ ID NO: 575 - protein, 17 aa, Homo sapiens
  IgG  CDR3 amino acids
CARGPGWGMGSTKFDCW

SEQ ID NO: 576 - protein, 20 aa, Homo sapiens
  IgG  CDR3 amino acids
CARGGKSATGANYHQFFDCW

SEQ ID NO: 577 - protein, 22 aa, Homo sapiens
  IgG  CDR3 amino acids
CARGDCTTINCNTHSTTTVWTS

SEQ ID NO: 578 - protein, 15 aa, Homo sapiens
  IgG  CDR3 amino acids
CARGATVGVETGSTL

SEQ ID NO: 579 - protein, 15 aa, Homo sapiens
  IgG  CDR3 amino acids
CARGATLGVETGWTP

SEQ ID NO: 580 - protein, 17 aa, Homo sapiens
  IgG  CDR3 amino acids
CAREYYGILYGYYFDYW

SEQ ID NO: 581 - protein, 17 aa, Homo sapiens
  IgG  CDR3 amino acids
CARDWEWQQRLNYFDPW

SEQ ID NO: 582 - protein, 20 aa, Homo sapiens
  IgG  CDR3 amino acids
CARDNQPWRDARNLGVHLMC

SEQ ID NO: 583 - protein, 16 aa, Homo sapiens
  IgG  CDR3 amino acids
CARDHYYDERNQGPDW

SEQ ID NO: 584 - protein, 15 aa, Homo sapiens
  IgG  CDR3 amino acids
CARDGGLAGTGTLEY

SEQ ID NO: 585 - protein, 16 aa, Homo sapiens
  IgG  CDR3 amino acids
CARAGLVLGPYGMDIW

SEQ ID NO: 586 - protein, 12 aa, Homo sapiens
  IgG  CDR3 amino acids
CARAGGHGTWTS

SEQ ID NO: 587 - protein, 24 aa, Homo sapiens
  IgG  CDR3 amino acids
CAKVAETLVSTGFDSYYAYSMDVW

SEQ ID NO: 588 - protein, 18 aa, Homo sapiens
  IgG  CDR3 amino acids
CAKTYDYGSRGFSILLIS

SEQ ID NO: 589 - protein, 15 aa, Homo sapiens
  IgG  CDR3 amino acids
CAKSLRVGGDVFEIW

SEQ ID NO: 590 - protein, 9 aa, Homo sapiens
  IgG  CDR3 amino acids
CAKSDYFDP

SEQ ID NO: 591 - protein, 17 aa, Homo sapiens
  IgG  CDR3 amino acids
CAKGRGRLVTIATTLTT

SEQ ID NO: 592 - protein, 16 aa, Homo sapiens
  IgG  CDR3 amino acids
CAKGAGRRAAGKFLTT

SEQ ID NO: 593 - protein, 27 aa, Homo sapiens
  IgG  CDR3 amino acids
CAKAKRRSLGMQTLPTLRGRSDGFDVW

SEQ ID NO: 594 - protein, 17 aa, Homo sapiens
  IgG  CDR3 amino acids
CAKAHFPGDLPSFSSIS

SEQ ID NO: 595 - protein, 16 aa, Homo sapiens
  IgG  CDR3 amino acids
CAKADCGTGCFIVDDW

SEQ ID NO: 596 - protein, 16 aa, Homo sapiens
  IgG  CDR3 amino acids
CAHQQWRPGRRGFDYW

SEQ ID NO: 597 - protein, 15 aa, Homo sapiens
  IGHD6-13  CDR3 amino acids
CARTYSSWYRGPLSP

SEQ ID NO: 598 - protein, 18 aa, Homo sapiens
  IGHD6-13  CDR3 amino acids
CTRQEESSAAGTGGTSSP

SEQ ID NO: 599 - protein, 18 aa, Homo sapiens
  IGHD6-13  CDR3 amino acids
CARPIAAAGSRGFGTLTT

SEQ ID NO: 600 - protein, 18 aa, Homo sapiens
  IGHD6-13  CDR3 amino acids
CAQRRPSSSTWYAPTLTT

SEQ ID NO: 601 - protein, 18 aa, Homo sapiens
  IGHD6-13  CDR3 amino acids
CAQRRPNSSTWYAPTLTT

SEQ ID NO: 602 - protein, 23 aa, Homo sapiens
  IGHD6-13  CDR3 amino acids
CARDLGGYSSSWSTNYYYYMDVW

SEQ ID NO: 603 - protein, 19 aa, Homo sapiens
  IGHD6-13  CDR3 amino acids
CAKVNWGIAAAGSYAFDIW

SEQ ID NO: 604 - protein, 21 aa, Homo sapiens
  IGHD6-13  CDR3 amino acids
CAHRVRGMTSSSWYYGTFDYW

SEQ ID NO: 605 - protein, 14 aa, Homo sapiens
  IGHD6-13  CDR3 amino acids
CVRPGATAGTLLTV

SEQ ID NO: 606 - protein, 16 aa, Homo sapiens
  IGHD6-13  CDR3 amino acids
CARTYSSWYRGGPLSP

SEQ ID NO: 607 - protein, 22 aa, Homo sapiens
  IGHD6-13  CDR3 amino acids
CARPQRYSSSWYDDYYYGMDVW

SEQ ID NO: 608 - protein, 19 aa, Homo sapiens
  IGHD6-13  CDR3 amino acids
CARPIAAAGSRGVRYFDYW

SEQ ID NO: 609 - protein, 23 aa, Homo sapiens
  IGHD6-13  CDR3 amino acids
CARGVLAPLYSSTLKLRFSVWTS

SEQ ID NO: 610 - protein, 18 aa, Homo sapiens
  IGHD6-13  CDR3 amino acids
CARGLVAAAGTRRGWFTP

SEQ ID NO: 611 - protein, 19 aa, Homo sapiens
  IGHD6-13  CDR3 amino acids
CARGLVAAAGTRRGWFDPW

SEQ ID NO: 612 - protein, 17 aa, Homo sapiens
  IGHD6-13  CDR3 amino acids
CARDSGQIVAAVTLDYW

SEQ ID NO: 613 - protein, 19 aa, Homo sapiens
  IGHD6-13  CDR3 amino acids
CARAPSIPVAGIGYHFDHW

SEQ ID NO: 614 - protein, 19 aa, Homo sapiens
  IGHD6-13  CDR3 amino acids
CAQRRPNSSTWYRPLTLTT

SEQ ID NO: 615 - protein, 19 aa, Homo sapiens
  IGHD6-13  CDR3 amino acids
CAKVNWGYSSCWFLRFLIS

SEQ ID NO: 616 - protein, 15 aa, Homo sapiens
  IGHD6-13  CDR3 amino acids
CAKEGVPIAAPGLTT

SEQ ID NO: 617 - protein, 13 aa, Homo sapiens
  IGHD6-13  CDR3 amino acids
CAHSRAAAGSLTT

SEQ ID NO: 618 - protein, 14 aa, Homo sapiens
  IGHD6-13  CDR3 amino acids
CAHSRAAAGSFDYW

SEQ ID NO: 619 - protein, 21 aa, Homo sapiens
  IGHD6-13  CDR3 amino acids
CAHRVRGNDKQQLVLWGPLTT

SEQ ID NO: 620 - protein, 20 aa, Homo sapiens
  IGHD6-13  CDR3 amino acids
CAHRVRGMTSSSWYYGTLTT

SEQ ID NO: 621 - protein, 10 aa, Homo sapiens
  IGHD2-15  CDR3 amino acids
CARVEGGLTT

SEQ ID NO: 622 - protein, 17 aa, Homo sapiens
  IGHD2-15  CDR3 amino acids
CAKGWTAARGALNTSST

SEQ ID NO: 623 - protein, 12 aa, Homo sapiens
  IGHD2-15  CDR3 amino acids
CARFWSGVGLTT

SEQ ID NO: 624 - protein, 21 aa, Homo sapiens
  IGHD2-15  CDR3 amino acids
CAREVYLYCNGGRCYWRGSSP

SEQ ID NO: 625 - protein, 22 aa, Homo sapiens
  IGHD2-15  CDR3 amino acids
CARSEYCRGGNCYFNGYYFDSW

SEQ ID NO: 626 - protein, 18 aa, Homo sapiens
  IGHD2-15  CDR3 amino acids
CARAPYCSGGSCYLFDYW

SEQ ID NO: 627 - protein, 22 aa, Homo sapiens
  IGHD2-15  CDR3 amino acids
CARGFVVVVTATLGTTITPWTS

SEQ ID NO: 628 - protein, 18 aa, Homo sapiens
  IGHD2-15  CDR3 amino acids
CARDLCGGSCSRTTGSTP

SEQ ID NO: 629 - protein, 19 aa, Homo sapiens
  IGHD2-15  CDR3 amino acids
CARAGYCSGGSCYGWFDPW

SEQ ID NO: 630 - protein, 17 aa, Homo sapiens
  IGHD2-15  CDR3 amino acids
CAKTKTGTTKINTTLTT

SEQ ID NO: 631 - protein, 19 aa, Homo sapiens
  IGHD2-15  CDR3 amino acids
CAKNGILTGWVNGYTTLTT

SEQ ID NO: 632 - protein, 21 aa, Homo sapiens
  IGHD2-15  CDR3 amino acids
CAKGQTTAILGSTDFNWFDPW

SEQ ID NO: 633 - protein, 19 aa, Homo sapiens
  IGHD2-15  CDR3 amino acids
CAKFHLQPSLLMVRRSPTS

SEQ ID NO: 634 - protein, 17 aa, Homo sapiens
  IGHD3-22  CDR3 amino acids
CARDPRGAVGITTGPTH

SEQ ID NO: 635 - protein, 17 aa, Homo sapiens
  IGHD3-22  CDR3 amino acids
CARGSPPGAVGFIGSTP

SEQ ID NO: 636 - protein, 20 aa, Homo sapiens
  IGHD3-22  CDR3 amino acids
CAKDMGGITMIVVVMISLTT

SEQ ID NO: 637 - protein, 16 aa, Homo sapiens
  IGHD3-22  CDR3 amino acids
CARARRGHGSTTTWTS

SEQ ID NO: 638 - protein, 12 aa, Homo sapiens
  IGHD3-22  CDR3 amino acids
CARDPPRMLLIS

SEQ ID NO: 639 - protein, 17 aa, Homo sapiens
  IGHD3-22  CDR3 amino acids
CARDLSYYDSSGYYAYW

SEQ ID NO: 640 - protein, 15 aa, Homo sapiens
  IGHD3-22  CDR3 amino acids
CATYKYYDSSGFMTT

SEQ ID NO: 641 - protein, 16 aa, Homo sapiens
  IGHD3-22  CDR3 amino acids
CATYKYYDSSGFHDYW

SEQ ID NO: 642 - protein, 17 aa, Homo sapiens
  IGHD3-22  CDR3 amino acids
CARDLSYYDSSGYYAYV

SEQ ID NO: 643 - protein, 21 aa, Homo sapiens
  IGHD3-22  CDR3 amino acids
CAHRRPYYYDSSGYYYAFDYW

SEQ ID NO: 644 - protein, 8 aa, Homo sapiens
  IGHD3-22  CDR3 amino acids
CLTMIVPT

SEQ ID NO: 645 - protein, 21 aa, Homo sapiens
  IGHD3-22  CDR3 amino acids
CATVTGGSSGYYYHVYYFDYW

SEQ ID NO: 646 - protein, 17 aa, Homo sapiens
  IGHD3-22  CDR3 amino acids
CARVRYSGGILGLPLTT

SEQ ID NO: 647 - protein, 21 aa, Homo sapiens
  IGHD3-22  CDR3 amino acids
CARGRRGIVVVIPKEVRFDYW

SEQ ID NO: 648 - protein, 19 aa, Homo sapiens
  IGHD3-22  CDR3 amino acids
CARGIWVSTGYYRYYFDNW

SEQ ID NO: 649 - protein, 21 aa, Homo sapiens
  IGHD3-22  CDR3 amino acids
CAREGYDSGGYYYEVEAFDIW

SEQ ID NO: 650 - protein, 22 aa, Homo sapiens
  IGHD3-22  CDR3 amino acids
CARDAGPITTTVAGIIMRLLTF

SEQ ID NO: 651 - protein, 20 aa, Homo sapiens
  IGHD3-22  CDR3 amino acids
CAHRRPITMIVVVITMPLTT

SEQ ID NO: 652 - protein, 16 aa, Homo sapiens
  IGHD5-5  CDR3 amino acids
CARGGGKDLLASYLTT

SEQ ID NO: 653 - protein, 14 aa, Homo sapiens
  IGHD5-5  CDR3 amino acids
CTSRGYSYGAPRWD

SEQ ID NO: 654 - protein, 23 aa, Homo sapiens
  IGHD5-5  CDR3 amino acids
CARRWGRGRDTAMNLTTTTVWTS

SEQ ID NO: 655 - protein, 13 aa, Homo sapiens
  IGHD5-5  CDR3 amino acids
CSRGGPGTAMVST

SEQ ID NO: 656 - protein, 23 aa, Homo sapiens
  IGHD5-5  CDR3 amino acids
CARRGGGGGDTAMNLTTTTVWTS

SEQ ID NO: 657 - protein, 15 aa, Homo sapiens
  IGHD5-5  CDR3 amino acids
CARHGDSFVQPRRTT

SEQ ID NO: 658 - protein, 13 aa, Homo sapiens
  IGHD5-5  CDR3 amino acids
CAKHDGQSNTLTA

SEQ ID NO: 659 - protein, 16 aa, Homo sapiens
  IGHD5-5  CDR3 amino acids
CATNTAMGFNEAVLIS

SEQ ID NO: 660 - protein, 16 aa, Homo sapiens
  IGHD5-5  CDR3 amino acids
CARRGYSSMGIWDLST

SEQ ID NO: 661 - protein, 23 aa, Homo sapiens
  IGHD5-5  CDR3 amino acids
CARRGGRGRDTAMNLTTTTVWTS

SEQ ID NO: 662 - protein, 19 aa, Homo sapiens
  IGHD5-5  CDR3 amino acids
CARQGSRLFHYYYYYMDVW

SEQ ID NO: 663 - protein, 15 aa, Homo sapiens
  IGHD5-5  CDR3 amino acids
CARHKPGYSYVFLTT

SEQ ID NO: 664 - protein, 13 aa, Homo sapiens
  IGHD3-10  CDR3 amino acids
CGREGAGSAPWTS

SEQ ID NO: 665 - protein, 20 aa, Homo sapiens
  IGHD3-10  CDR3 amino acids
CARHRITMVRELSYTTTWTS

SEQ ID NO: 666 - protein, 22 aa, Homo sapiens
  IGHD3-10  CDR3 amino acids
CARDSDQQHGVRGVIPMAVWTS

SEQ ID NO: 667 - protein, 19 aa, Homo sapiens
  IGHD3-10  CDR3 amino acids
CATTPLMTLVRGLTTTWTS

SEQ ID NO: 668 - protein, 20 aa, Homo sapiens
  IGHD3-10  CDR3 amino acids
CARHQVSMVRGVTRSTGSTP

SEQ ID NO: 669 - protein, 21 aa, Homo sapiens
  IGHD3-10  CDR3 amino acids
CARDEWFGESEVTNLDAFDIW

SEQ ID NO: 670 - protein, 21 aa, Homo sapiens
  IGHD3-10  CDR3 amino acids
CAHSEGRITMVRGVIGPFDYW

SEQ ID NO: 671 - protein, 17 aa, Homo sapiens
  IGHD3-10  CDR3 amino acids
CARGQTYGSGPRGFDPW

SEQ ID NO: 672 - protein, 22 aa, Homo sapiens
  IGHD3-10  CDR3 amino acids
CARGLYGSGSYYIKRRKTGSTP

SEQ ID NO: 673 - protein, 14 aa, Homo sapiens
  IGHD3-10  CDR3 amino acids
CARAMVRGVLALTT

SEQ ID NO: 674 - protein, 18 aa, Homo sapiens
  IGHD3-10  CDR3 amino acids
CAKVGVGSMTMDRGVMTT

SEQ ID NO: 675 - protein, 16 aa, Homo sapiens
  IGHD3-3  CDR3 amino acids
CARDPFGVVISTVWTS

SEQ ID NO: 676 - protein, 21 aa, Homo sapiens
  IGHD3-3  CDR3 amino acids
CARDRGRVLRFCPQGVPSLTT

SEQ ID NO: 677 - protein, 21 aa, Homo sapiens
  IGHD3-3  CDR3 amino acids
CASQTYYDFGVVIILLTTLTT

SEQ ID NO: 678 - protein, 14 aa, Homo sapiens
  IGHD3-3  CDR3 amino acids
CASLDFGVVIILTS

SEQ ID NO: 679 - protein, 22 aa, Homo sapiens
  IGHD3-3  CDR3 amino acids
CARHRSITILEWFVNHETGSTP

SEQ ID NO: 680 - protein, 20 aa, Homo sapiens
  IGHD3-3  CDR3 amino acids
CAQSHYDFGVVIILIPGSTP

SEQ ID NO: 681 - protein, 20 aa, Homo sapiens
  IGHD3-3  CDR3 amino acids
CARGSPHYDFGVEIRTGSTP

SEQ ID NO: 682 - protein, 17 aa, Homo sapiens
  IGHD3-3  CDR3 amino acids
CARDPLWSGYFYGMDVW

SEQ ID NO: 683 - protein, 16 aa, Homo sapiens
  IGHD3-3  CDR3 amino acids
CARVGTYDFGVVMSNS

SEQ ID NO: 684 - protein, 23 aa, Homo sapiens
  IGHD3-3  CDR3 amino acids
CARHRSITIFGVVRKSRNWFDPW

SEQ ID NO: 685 - protein, 24 aa, Homo sapiens
  IGHD3-3  CDR3 amino acids
CARDRFSLNSAFGVVEGSYWFDPW

SEQ ID NO: 686 - protein, 21 aa, Homo sapiens
  IGHD3-3  CDR3 amino acids
CAQSHYDFWSGYYSNTGFDPW

SEQ ID NO: 687 - protein, 17 aa, Homo sapiens
  IGHD1-26  CDR3 amino acids
CASVGGTRGPGDPGLGT

SEQ ID NO: 688 - protein, 14 aa, Homo sapiens
  IGHD1-26  CDR3 amino acids
CAKGGFIVGATLTT

SEQ ID NO: 689 - protein, 15 aa, Homo sapiens
  IGHD1-26  CDR3 amino acids
CAKEGGRIVGATMTT

SEQ ID NO: 690 - protein, 18 aa, Homo sapiens
  IGHD1-26  CDR3 amino acids
CARVRYSGRYSRSTVDYW

SEQ ID NO: 691 - protein, 18 aa, Homo sapiens
  IGHD1-26  CDR3 amino acids
CARLKCGLTTCLHKTLIS

SEQ ID NO: 692 - protein, 14 aa, Homo sapiens
  IGHD1-26  CDR3 amino acids
CARDSVGATTTDYW

SEQ ID NO: 693 - protein, 15 aa, Homo sapiens
  IGHD6-19  CDR3 amino acids
CAHPGSGWPLTTLTT

SEQ ID NO: 694 - protein, 15 aa, Homo sapiens
  IGHD6-19  CDR3 amino acids
CARGCSVAGTGSSTP

SEQ ID NO: 695 - protein, 15 aa, Homo sapiens
  IGHD6-19  CDR3 amino acids
CARARITVAAPYDYW

SEQ ID NO: 696 - protein, 13 aa, Homo sapiens
  IGHD6-19  CDR3 amino acids
CARLISSGWYLTT

SEQ ID NO: 697 - protein, 25 aa, Homo sapiens
  IGHD6-19  CDR3 amino acids
CARTSLEQQLVFMTENSSGWSFDYW

SEQ ID NO: 698 - protein, 17 aa, Homo sapiens
  IGHD6-19  CDR3 amino acids
CARGGIAVAGTRIKTTT

SEQ ID NO: 699 - protein, 12 aa, Homo sapiens
  IGHD6-19  CDR3 amino acids
CARDQQWLPDYV

SEQ ID NO: 700 - protein, 14 aa, Homo sapiens
  IGHD6-19  CDR3 amino acids
CARARITVAAPYDY

SEQ ID NO: 701 - protein, 14 aa, Homo sapiens
  IGHD6-19  CDR3 amino acids
CARARITVAAPMTT

SEQ ID NO: 702 - protein, 16 aa, Homo sapiens
  IGHD6-19  CDR3 amino acids
CAKGVGSGWYDFFDYW

SEQ ID NO: 703 - protein, 19 aa, Homo sapiens
  IGHD6-19  CDR3 amino acids
CAKGPREQWLAPYWYFDLW

SEQ ID NO: 704 - protein, 14 aa, Homo sapiens
  IGHD3-9  CDR3 amino acids
CARGGSLVLDVLTT

SEQ ID NO: 705 - protein, 14 aa, Homo sapiens
  IGHD3-9  CDR3 amino acids
CARGGSLMLDVLTT

SEQ ID NO: 706 - protein, 17 aa, Homo sapiens
  IGHD3-9  CDR3 amino acids
CASGPYFDWLLTYMDVW

SEQ ID NO: 707 - protein, 23 aa, Homo sapiens
  IGHD3-9  CDR3 amino acids
CARGPLYDILTGPTPTTTTTWTS

SEQ ID NO: 708 - protein, 14 aa, Homo sapiens
  IGHD3-9  CDR3 amino acids
CARGGSIVLDVLTT

SEQ ID NO: 709 - protein, 12 aa, Homo sapiens
  IGHD2-8  CDR3 amino acids
CAKWGGNSSWKS

SEQ ID NO: 710 - protein, 25 aa, Homo sapiens
  IGHD2-8  CDR3 amino acids
CARRSWCTNGVCYYISVALVTGSTP

SEQ ID NO: 711 - protein, 20 aa, Homo sapiens
  IGHD2-8  CDR3 amino acids
CARGSRYCTNGVCYFWFDPW

SEQ ID NO: 712 - protein, 29 aa, Homo sapiens
  IGHD2-8  CDR3 amino acids
CARDVLGYCTATACWRGGPNHYYYGMDVW

SEQ ID NO: 713 - protein, 14 aa, Homo sapiens
  IGHD5-24  CDR3 amino acids
CARGIEMATILLTT

SEQ ID NO: 714 - protein, 14 aa, Homo sapiens
  IGHD5-24  CDR3 amino acids
CARGSRWLQFFDYW

SEQ ID NO: 715 - protein, 18 aa, Homo sapiens
  IGHD5-24  CDR3 amino acids
CAKGGERWLQSGATTLTT

SEQ ID NO: 716 - protein, 17 aa, Homo sapiens
  IGHD6-6  CDR3 amino acids
CTRGLVIEDIAARPGGA

SEQ ID NO: 717 - protein, 20 aa, Homo sapiens
  IGHD6-6  CDR3 amino acids
CASDRGVQLVQDYYFGMDVW

SEQ ID NO: 718 - protein, 18 aa, Homo sapiens
  IGHD5-12  CDR3 amino acids
CARNARGGVATIFRGSTP

SEQ ID NO: 719 - protein, 22 aa, Homo sapiens
  IGHD5-12  CDR3 amino acids
CARIQVATIDPKPKRLPSVWTS

SEQ ID NO: 720 - protein, 19 aa, Homo sapiens
  IGHD4-17  CDR3 amino acids
CARDWNGDYDYYYYGMDVW

SEQ ID NO: 721 - protein, 18 aa, Homo sapiens
  IGHD4-17  CDR3 amino acids
CARDWNGDYTTTTTVWTS

SEQ ID NO: 722 - protein, 16 aa, Homo sapiens
  IGHD2-2  CDR3 amino acids
CARDRSSTSCCHFDYL

SEQ ID NO: 723 - protein, 19 aa, Homo sapiens
  IGHD2-21  CDR3 amino acids
CARGPAYCGSDCYSYFQHW

SEQ ID NO: 724 - protein, 14 aa, Homo sapiens
  IGHD4-23  CDR3 amino acids
CARGGDYGGTPLTT

SEQ ID NO: 725 - protein, 17 aa, Homo sapiens
  IGHD1-7  CDR3 amino acids
CARDGPPRITGTTEVTT

SEQ ID NO: 726 - protein, 13 aa, Homo sapiens
  IGHD1-1  CDR3 amino acids
CARRVGASGTSIS

SEQ ID NO: 727 - protein, 19 aa, Homo sapiens
  IGHD3-16  CDR3 amino acids
CARAHYDYVWGSYRSPPTT

SEQ ID NO: 728 - protein, 17 aa, Homo sapiens
  IGHD4-4  CDR3 amino acids
CARPVTTGTHRGYFDLW

SEQ ID NO: 729 - protein, 17 aa, Homo sapiens
  IgM  CDR3 amino acids
CASVGGTRVPGDPGLGT

SEQ ID NO: 730 - protein, 19 aa, Homo sapiens
  IgM  CDR3 amino acids
CAHLTITFGEFSERMLSTS

SEQ ID NO: 731 - protein, 12 aa, Homo sapiens
  IgM  CDR3 amino acids
CARLGYYDRRTT

SEQ ID NO: 732 - protein, 13 aa, Homo sapiens
  IgM  CDR3 amino acids
CAGEVVIWNSMTT

SEQ ID NO: 733 - protein, 13 aa, Homo sapiens
  IgM  CDR3 amino acids
CARGARGDNSTMT

SEQ ID NO: 734 - protein, 15 aa, Homo sapiens
  IgM  CDR3 amino acids
CARGGSRWPRTTLTT

SEQ ID NO: 735 - protein, 14 aa, Homo sapiens
  IgM  CDR3 amino acids
CARMGGPPTGTSIS

SEQ ID NO: 736 - protein, 11 aa, Homo sapiens
  IgM  CDR3 amino acids
CVRGGLYTIPT

SEQ ID NO: 737 - protein, 18 aa, Homo sapiens
  IgM  CDR3 amino acids
CARGGCGNYCPTTTSWTS

SEQ ID NO: 738 - protein, 14 aa, Homo sapiens
  IgM  CDR3 amino acids
CARRDSSRGTTLTT

SEQ ID NO: 739 - protein, 15 aa, Homo sapiens
  IgM  CDR3 amino acids
CARTTGTTTTTTWTS

SEQ ID NO: 740 - protein, 16 aa, Homo sapiens
  IgM  CDR3 amino acids
CARLSRYSNSPPSLTT

SEQ ID NO: 741 - protein, 16 aa, Homo sapiens
  IgM  CDR3 amino acids
CARHLGVRGPWALFIS

SEQ ID NO: 742 - protein, 12 aa, Homo sapiens
  IgM  CDR3 amino acids
CARDPPRMLLIS

SEQ ID NO: 743 - protein, 9 aa, Homo sapiens
  IgM  CDR3 amino acids
CAKGDIVTT

SEQ ID NO: 744 - protein, 16 aa, Homo sapiens
  IgM  CDR3 amino acids
CARGGGVSSRRITSTP

SEQ ID NO: 745 - protein, 11 aa, Homo sapiens
  IgM  CDR3 amino acids
CAREGVRSLTT

SEQ ID NO: 746 - protein, 15 aa, Homo sapiens
  IgM  CDR3 amino acids
CAKDKTYDTHGYSPF

SEQ ID NO: 747 - protein, 17 aa, Homo sapiens
  IgM  CDR3 amino acids
CASLLLPTVTGGVLLIS

SEQ ID NO: 748 - protein, 13 aa, Homo sapiens
  IgM  CDR3 amino acids
CARDYGATGSLDC

SEQ ID NO: 749 - protein, 16 aa, Homo sapiens
  IgM  CDR3 amino acids
CARDFGSGGVLITWPS

SEQ ID NO: 750 - protein, 17 aa, Homo sapiens
  IgM  CDR3 amino acids
CARYPGIEVTGTGALTT

SEQ ID NO: 751 - protein, 19 aa, Homo sapiens
  IgM  CDR3 amino acids
CARRGDVGNYCPTTTSWTS

SEQ ID NO: 752 - protein, 16 aa, Homo sapiens
  IgM  CDR3 amino acids
CARLPGITTTTTTWTS

SEQ ID NO: 753 - protein, 18 aa, Homo sapiens
  IgM  CDR3 amino acids
CARHVKPVDGNAYYEDSV

SEQ ID NO: 754 - protein, 17 aa, Homo sapiens
  IgM  CDR3 amino acids
CARGTRGISEPTKFDYW

SEQ ID NO: 755 - protein, 13 aa, Homo sapiens
  IgM  CDR3 amino acids
CARGGPERQLDDS

SEQ ID NO: 756 - protein, 18 aa, Homo sapiens
  IgM  CDR3 amino acids
CAHRRPDSSTWYAPTLTT

SEQ ID NO: 757 - protein, 16 aa, Homo sapiens
  IgM  CDR3 amino acids
CVSRRQTTPTSTVGPS

SEQ ID NO: 758 - protein, 11 aa, Homo sapiens
  IgM  CDR3 amino acids
CVRKEVMYFDP

SEQ ID NO: 759 - protein, 13 aa, Homo sapiens
  IgM  CDR3 amino acids
CGDTLGETMPVTA

SEQ ID NO: 760 - protein, 11 aa, Homo sapiens
  IgM  CDR3 amino acids
CATRRGQFWTT

SEQ ID NO: 761 - protein, 18 aa, Homo sapiens
  IgM  CDR3 amino acids
CARVVGGGVTTTTTVWTS

SEQ ID NO: 762 - protein, 19 aa, Homo sapiens
  IgM  CDR3 amino acids
CARVLLSGSTWYAEYFQSW

SEQ ID NO: 763 - protein, 16 aa, Homo sapiens
  IgM  CDR3 amino acids
CARTLSATGDNWFGPW

SEQ ID NO: 764 - protein, 15 aa, Homo sapiens
  IgM  CDR3 amino acids
CARTGARGDNSTMTS

SEQ ID NO: 765 - protein, 20 aa, Homo sapiens
  IgM  CDR3 amino acids
CARQTPGTLQTTTTTTVWTS

SEQ ID NO: 766 - protein, 14 aa, Homo sapiens
  IgM  CDR3 amino acids
CARPRYDYGLLLIS

SEQ ID NO: 767 - protein, 17 aa, Homo sapiens
  IgM  CDR3 amino acids
CARLTRRTTVVPRTSTT

SEQ ID NO: 768 - protein, 18 aa, Homo sapiens
  IgM  CDR3 amino acids
CARHVKPVDGNAYYEDSW

SEQ ID NO: 769 - protein, 16 aa, Homo sapiens
  IgM  CDR3 amino acids
CARHRGVRGPWALFIS

SEQ ID NO: 770 - protein, 17 aa, Homo sapiens
  IgM  CDR3 amino acids
CARGSPPGAVGFIGSTP

SEQ ID NO: 771 - protein, 15 aa, Homo sapiens
  IgM  CDR3 amino acids
CARGLSSSRSLSSTP

SEQ ID NO: 772 - protein, 10 aa, Homo sapiens
  IgM  CDR3 amino acids
CARGGATPGG

SEQ ID NO: 773 - protein, 18 aa, Homo sapiens
  IgM  CDR3 amino acids
CAREVPTGPRTSTTVWTS

SEQ ID NO: 774 - protein, 15 aa, Homo sapiens
  IgM  CDR3 amino acids
CARDPRADYLAFDIW

SEQ ID NO: 775 - protein, 15 aa, Homo sapiens
  IgM  CDR3 amino acids
CANGDTARPTGTLAT

SEQ ID NO: 776 - protein, 19 aa, Homo sapiens
  IgM  CDR3 amino acids
CAKAPSDTIIVHGPQHLTT

SEQ ID NO: 777 - protein, 11 aa, Homo sapiens
  IgM  CDR3 amino acids
CAARGRTTLTT

SEQ ID NO: 778 - protein, 12 aa, Homo sapiens
  IgM  CDR3 amino acids
CVRGSGRTGEAT

SEQ ID NO: 779 - protein, 20 aa, Homo sapiens
  IgM  CDR3 amino acids
CVREARTPATTYGWYYYDYW

SEQ ID NO: 780 - protein, 22 aa, Homo sapiens
  IgM  CDR3 amino acids
CVRDNSWSSRDAERYYYNMDVW

SEQ ID NO: 781 - protein, 21 aa, Homo sapiens
  IgM  CDR3 amino acids
CVRDLAWRTQQLLSENWFDPW

SEQ ID NO: 782 - protein, 20 aa, Homo sapiens
  IgM  CDR3 amino acids
CVRDLAWRTQQLLSEIGSTV

SEQ ID NO: 783 - protein, 21 aa, Homo sapiens
  IgM  CDR3 amino acids
CVRDLAWRTEQLLSENWFDPW

SEQ ID NO: 784 - protein, 21 aa, Homo sapiens
  IgM  CDR3 amino acids
CVRDLAWRTEELLSENWFDTW

SEQ ID NO: 785 - protein, 21 aa, Homo sapiens
  IgM  CDR3 amino acids
CVRDLAWRTEELLSENWFDPW

SEQ ID NO: 786 - protein, 20 aa, Homo sapiens
  IgM  CDR3 amino acids
CVRDLAWRTEELLSEIGSTL

SEQ ID NO: 787 - protein, 14 aa, Homo sapiens
  IgM  CDR3 amino acids
CVHRPRWLNIVANV

SEQ ID NO: 788 - protein, 13 aa, Homo sapiens
  IgM  CDR3 amino acids
CTWWQQLGEFLTS

SEQ ID NO: 789 - protein, 15 aa, Homo sapiens
  IgM  CDR3 amino acids
CTSLTSMVNFMLLMS

SEQ ID NO: 790 - protein, 18 aa, Homo sapiens
  IgM  CDR3 amino acids
CTRQEESSAAGTGGTSSP

SEQ ID NO: 791 - protein, 16 aa, Homo sapiens
  IgM  CDR3 amino acids
CTRDGVRGDLNPTLNV

SEQ ID NO: 792 - protein, 12 aa, Homo sapiens
  IgM  CDR3 amino acids
CMRHQHQRPRTT

SEQ ID NO: 793 - protein, 19 aa, Homo sapiens
  IgM  CDR3 amino acids
CITDCTGGSCDFAGPGEYW

SEQ ID NO: 794 - protein, 16 aa, Homo sapiens
  IgM  CDR3 amino acids
CATYYYKLVVIDTLTT

SEQ ID NO: 795 - protein, 12 aa, Homo sapiens
  IgM  CDR3 amino acids
CATGAATVLLTT

SEQ ID NO: 796 - protein, 14 aa, Homo sapiens
  IgM  CDR3 amino acids
CASRPGHHSGPLTT

SEQ ID NO: 797 - protein, 15 aa, Homo sapiens
  IgM  CDR3 amino acids
CASRPGHHSGPFDYW

SEQ ID NO: 798 - protein, 10 aa, Homo sapiens
  IgM  CDR3 amino acids
CASPVGGGET

SEQ ID NO: 799 - protein, 14 aa, Homo sapiens
  IgM  CDR3 amino acids
CARWPPIQGELLIS

SEQ ID NO: 800 - protein, 18 aa, Homo sapiens
  IgM  CDR3 amino acids
CARVRSGLLPTTTTTWTS

SEQ ID NO: 801 - protein, 17 aa, Homo sapiens
  IgM  CDR3 amino acids
CARVQLIGDSGYRPWTT

SEQ ID NO: 802 - protein, 13 aa, Homo sapiens
  IgM  CDR3 amino acids
CARVLRGPTTLTT

SEQ ID NO: 803 - protein, 14 aa, Homo sapiens
  IgM  CDR3 amino acids
CARQWGIRGVALTT

SEQ ID NO: 804 - protein, 15 aa, Homo sapiens
  IgM  CDR3 amino acids
CARPRYDLRFCLLIS

SEQ ID NO: 805 - protein, 10 aa, Homo sapiens
  IgM  CDR3 amino acids
CARNTEATTT

SEQ ID NO: 806 - protein, 19 aa, Homo sapiens
  IgM  CDR3 amino acids
CARMPGKEIAMADLATLTT

SEQ ID NO: 807 - protein, 18 aa, Homo sapiens
  IgM  CDR3 amino acids
CARLTRRTTVGTPDIDYV

SEQ ID NO: 808 - protein, 17 aa, Homo sapiens
  IgM  CDR3 amino acids
CARHVKPVDGNAYYEDS

SEQ ID NO: 809 - protein, 7 aa, Homo sapiens
  IgM  CDR3 amino acids
CARHLVW

SEQ ID NO: 810 - protein, 16 aa, Homo sapiens
  IgM  CDR3 amino acids
CARHDPVPQFKHGWTS

SEQ ID NO: 811 - protein, 13 aa, Homo sapiens
  IgM  CDR3 amino acids
CARGGPGRQLTMT

SEQ ID NO: 812 - protein, 16 aa, Homo sapiens
  IgM  CDR3 amino acids
CARGGGKDLLASYLTT

SEQ ID NO: 813 - protein, 13 aa, Homo sapiens
  IgM  CDR3 amino acids
CARGARSGSSMTA

SEQ ID NO: 814 - protein, 14 aa, Homo sapiens
  IgM  CDR3 amino acids
CARDYGATGSLDCW

SEQ ID NO: 815 - protein, 18 aa, Homo sapiens
  IgM  CDR3 amino acids
CARDVIGAAASYVAFDIW

SEQ ID NO: 816 - protein, 20 aa, Homo sapiens
  IgM  CDR3 amino acids
CARDEWFGSPKSRTLMLLIS

SEQ ID NO: 817 - protein, 16 aa, Homo sapiens
  IgM  CDR3 amino acids
CARAQNWDLLTGTSIS

SEQ ID NO: 818 - protein, 18 aa, Homo sapiens
  IgM  CDR3 amino acids
CARAPSIPVAVSATTLTT

SEQ ID NO: 819 - protein, 14 aa, Homo sapiens
  IgM  CDR3 amino acids
CAKHDGQSNTPDCW

SEQ ID NO: 820 - protein, 17 aa, Homo sapiens
  IgM  CDR3 amino acids
CAKGWTAARGALNTSST

SEQ ID NO: 821 - protein, 16 aa, Homo sapiens
  IgM  CDR3 amino acids
CAKGPPVVTTLDTSST

SEQ ID NO: 822 - protein, 8 aa, Homo sapiens
  IgM  CDR3 amino acids
CAKDRGGS

SEQ ID NO: 823 - protein, 20 aa, Homo sapiens
  IGHD3-22  CDR3 amino acids
CARRPIPPLTMRVVVIPLTS

SEQ ID NO: 824 - protein, 17 aa, Homo sapiens
  IGHD3-22  CDR3 amino acids
CARDPPMPMIVVQTLTT

SEQ ID NO: 825 - protein, 17 aa, Homo sapiens
  IGHD3-22  CDR3 amino acids
CARDPPMPMILVQTLTT

SEQ ID NO: 826 - protein, 19 aa, Homo sapiens
  IGHD3-22  CDR3 amino acids
CAKILITMILVVSLMLLIS

SEQ ID NO: 827 - protein, 15 aa, Homo sapiens
  IGHD6-13  CDR3 amino acids
CGRSRHSSSWQILTP

SEQ ID NO: 828 - protein, 15 aa, Homo sapiens
  IGHD6-13  CDR3 amino acids
CANGGLAAAGDHLTT

SEQ ID NO: 829 - protein, 19 aa, Homo sapiens
  IGHD6-13  CDR3 amino acids
CARAPSIPVAGIGYHFDHW

SEQ ID NO: 830 - protein, 18 aa, Homo sapiens
  IGHD6-13  CDR3 amino acids
CARAPSIPVAGIATTLTT

SEQ ID NO: 831 - protein, 23 aa, Homo sapiens
  IGHD3-10  CDR3 amino acids
CAREIRGTTMVRELTTSTATWTP

SEQ ID NO: 832 - protein, 23 aa, Homo sapiens
  IGHD3-10  CDR3 amino acids
CVRTYYFGLGDIITEITSTVWTS

SEQ ID NO: 833 - protein, 15 aa, Homo sapiens
  IGHD3-10  CDR3 amino acids
CARRTYYYGSTNLTT

SEQ ID NO: 834 - protein, 20 aa, Homo sapiens
  IGHD3-10  CDR3 amino acids
CARMVTDYYGSGNRGWFDPW

SEQ ID NO: 835 - protein, 13 aa, Homo sapiens
  IGHD3-10  CDR3 amino acids
CARDYYGSGVMTL

SEQ ID NO: 836 - protein, 9 aa, Homo sapiens
  IGHD5-5  CDR3 amino acids
CMGPGDTAI

SEQ ID NO: 837 - protein, 18 aa, Homo sapiens
  IGHD5-5  CDR3 amino acids
CARRPREMESAMVLSLTT

SEQ ID NO: 838 - protein, 25 aa, Homo sapiens
  IGHD3-9  CDR3 amino acids
CAHSAPYYDILSRNRARSWKDFDNW

SEQ ID NO: 839 - protein, 24 aa, Homo sapiens
  IGHD3-9  CDR3 amino acids
CAHSAPIMIFCLVTAHEVGRILTT

SEQ ID NO: 840 - protein, 16 aa, Homo sapiens
  IGHD3-9  CDR3 amino acids
CATVALLRYFDWSSTR

SEQ ID NO: 841 - protein, 14 aa, Homo sapiens
  IGHD3-3  CDR3 amino acids
CTRRGGVVIICLTT

SEQ ID NO: 842 - protein, 18 aa, Homo sapiens
  IGHD3-3  CDR3 amino acids
CIHTGNDFWTGTNYGLTS

SEQ ID NO: 843 - protein, 23 aa, Homo sapiens
  IGHD3-3  CDR3 amino acids
CAKDRFSGRGRFEFMEWLTPLTT

SEQ ID NO: 844 - protein, 22 aa, Homo sapiens
  IGHD3-3  CDR3 amino acids
CAKDRFSEGKVQFMEWLTPLTT

SEQ ID NO: 845 - protein, 26 aa, Homo sapiens
  IGHD6-19  CDR3 amino acids
CARGRRSLPAIVYSSGPDRPNWFDPW

SEQ ID NO: 846 - protein, 20 aa, Homo sapiens
  IGHD6-19  CDR3 amino acids
CTSAAVASSSGWPLRGVWTS

SEQ ID NO: 847 - protein, 19 aa, Homo sapiens
  IGHD2-2  CDR3 amino acids
CARAPLCSSASCHLQLDYW

SEQ ID NO: 848 - protein, 14 aa, Homo sapiens
  IGHD1-26  CDR3 amino acids
CARDDSASYSRGTT

SEQ ID NO: 849 - protein, 20 aa, Homo sapiens
  IGHD2-21  CDR3 amino acids
CARSHIVVVTAIPLEMLLIS

SEQ ID NO: 850 - protein, 16 aa, Homo sapiens
  IGHD4-23  CDR3 amino acids
CARGAGYGGNSGVRTT

SEQ ID NO: 851 - protein, 26 aa, Homo sapiens
  IGHD2-15  CDR3 amino acids
CAKDLAPLKSCSRGGCYPYYYGLDIW

SEQ ID NO: 852 - protein, 12 aa, Homo sapiens
  IGHD4-17  CDR3 amino acids
CARTLYGDFVDF

SEQ ID NO: 853 - protein, 17 aa, Homo sapiens
  IGHD5-12  CDR3 amino acids
CARHVNGYDYLFPFTSW

SEQ ID NO: 854 - protein, 20 aa, Homo sapiens
  IGHD3-16  CDR3 amino acids
CAKGVLSSGGVIATLPGSTP

SEQ ID NO: 855 - protein, 17 aa, Homo sapiens
  IGHD1-1  CDR3 amino acids
CARGGSQLERRRPLVTT

SEQ ID NO: 856 - protein, 12 aa, Homo sapiens
  IGHA1  CDR3 amino acids
CARETVGGTLTT

SEQ ID NO: 857 - protein, 18 aa, Homo sapiens
  IGHA1  CDR3 amino acids
CARISSGHDPPIITGWTS

SEQ ID NO: 858 - protein, 19 aa, Homo sapiens
  IGHA1  CDR3 amino acids
CARSPIWFGSHRFTTTWRS

SEQ ID NO: 859 - protein, 15 aa, Homo sapiens
  IGHA1  CDR3 amino acids
CARDPLETGATSLII

SEQ ID NO: 860 - protein, 20 aa, Homo sapiens
  IGHA1  CDR3 amino acids
CAKLGNRPGFTEWDHWFGPW

SEQ ID NO: 861 - protein, 15 aa, Homo sapiens
  IGHA1  CDR3 amino acids
CVRDPHETGATTLIT

SEQ ID NO: 862 - protein, 17 aa, Homo sapiens
  IGHA1  CDR3 amino acids
CARIRKEVGAPPITWTS

SEQ ID NO: 863 - protein, 16 aa, Homo sapiens
  IGHA1  CDR3 amino acids
CARGSWSGAAFYSLTT

SEQ ID NO: 864 - protein, 16 aa, Homo sapiens
  IGHA1  CDR3 amino acids
CARDPNKFRTNHLSTT

SEQ ID NO: 865 - protein, 20 aa, Homo sapiens
  IGHA1  CDR3 amino acids
CATVPELTDISLPRLMALIS

SEQ ID NO: 866 - protein, 12 aa, Homo sapiens
  IGHA1  CDR3 amino acids
CARVWGKHTLTT

SEQ ID NO: 867 - protein, 16 aa, Homo sapiens
  IGHA1  CDR3 amino acids
CARDPNKFRPNHLSTT

SEQ ID NO: 868 - protein, 15 aa, Homo sapiens
  IGHA1  CDR3 amino acids
CARAGRELLRALMTT

SEQ ID NO: 869 - protein, 15 aa, Homo sapiens
  IGHA1  CDR3 amino acids
CARAGAELLRALMTT

SEQ ID NO: 870 - protein, 18 aa, Homo sapiens
  IGHA1  CDR3 amino acids
CARAEDYYDTEGYFYLTP

SEQ ID NO: 871 - protein, 20 aa, Homo sapiens
  IGHA1  CDR3 amino acids
CAHRTNYSTNRYGAFTTLTS

SEQ ID NO: 872 - protein, 15 aa, Homo sapiens
  IGHA1  CDR3 amino acids
CVRDPQETGATTLIT

SEQ ID NO: 873 - protein, 20 aa, Homo sapiens
  IGHA1  CDR3 amino acids
CATQCLGGAGLTTTTAPWTS

SEQ ID NO: 874 - protein, 15 aa, Homo sapiens
  IGHA1  CDR3 amino acids
CARRTYYSGSTNLTT

SEQ ID NO: 875 - protein, 14 aa, Homo sapiens
  IGHA1  CDR3 amino acids
CARRTTRETGSSIS

SEQ ID NO: 876 - protein, 14 aa, Homo sapiens
  IGHA1  CDR3 amino acids
CVRQYGLGSGSLTP

SEQ ID NO: 877 - protein, 15 aa, Homo sapiens
  IGHA1  CDR3 amino acids
CVKIRNLIGFTGSTP

SEQ ID NO: 878 - protein, 16 aa, Homo sapiens
  IGHA1  CDR3 amino acids
CTRDGVRGDLNPTLNV

SEQ ID NO: 879 - protein, 12 aa, Homo sapiens
  IGHA1  CDR3 amino acids
CDKAKVTADLRT

SEQ ID NO: 880 - protein, 20 aa, Homo sapiens
  IGHA1  CDR3 amino acids
CATVPELPDISLPRLMALIS

SEQ ID NO: 881 - protein, 14 aa, Homo sapiens
  IGHA1  CDR3 amino acids
CATVFGRRYRLLTT

SEQ ID NO: 882 - protein, 15 aa, Homo sapiens
  IGHA1  CDR3 amino acids
CARYRAAYPRRAWTS

SEQ ID NO: 883 - protein, 20 aa, Homo sapiens
  IGHA1  CDR3 amino acids
CARTIGFEIAMTGGLGALTP

SEQ ID NO: 884 - protein, 18 aa, Homo sapiens
  IGHA1  CDR3 amino acids
CARRDPPVRASLSTTLTS

SEQ ID NO: 885 - protein, 23 aa, Homo sapiens
  IGHA1  CDR3 amino acids
CARFQRYCRGGSCSATLDAFDKW

SEQ ID NO: 886 - protein, 20 aa, Homo sapiens
  IGHA1  CDR3 amino acids
CARDLGERRDGEPTNWFDAW

SEQ ID NO: 887 - protein, 13 aa, Homo sapiens
  IGHA1  CDR3 amino acids
CARDLAVWATLTT

SEQ ID NO: 888 - protein, 17 aa, Homo sapiens
  IGHA1  CDR3 amino acids
CAKDVEPTVTLYNHFDP

SEQ ID NO: 889 - protein, 11 aa, Homo sapiens
  IGHA1  CDR3 amino acids
CAKDFNWEGIT

SEQ ID NO: 890 - protein, 21 aa, Homo sapiens
  IGHA1  CDR3 amino acids
CAHRTNYSTNRYGGLYYFDFW

SEQ ID NO: 891 - protein, 13 aa, Homo sapiens
  IGHA1  CDR3 amino acids
CVRGVGTILWLTI

SEQ ID NO: 892 - protein, 13 aa, Homo sapiens
  IGHA1  CDR3 amino acids
CVRDAGPGGSLTS

SEQ ID NO: 893 - protein, 27 aa, Homo sapiens
  IGHA1  CDR3 amino acids
CTTGFSGSTACHWDHTACHWDDAFAMW

SEQ ID NO: 894 - protein, 15 aa, Homo sapiens
  IGHA1  CDR3 amino acids
CTHAVESLLGTTSTS

SEQ ID NO: 895 - protein, 18 aa, Homo sapiens
  IGHA1  CDR3 amino acids
CIHTGNDFGPGPTMVWTS

SEQ ID NO: 896 - protein, 16 aa, Homo sapiens
  IGHA1  CDR3 amino acids
CGVGRGDNDVDFKFKW

SEQ ID NO: 897 - protein, 10 aa, Homo sapiens
  IGHA1  CDR3 amino acids
CATRESPLTT

SEQ ID NO: 898 - protein, 15 aa, Homo sapiens
  IGHA1  CDR3 amino acids
CATAGIELWRAGSTP

SEQ ID NO: 899 - protein, 17 aa, Homo sapiens
  IGHA1  CDR3 amino acids
CARYRIAMATSPYFDYW

SEQ ID NO: 900 - protein, 22 aa, Homo sapiens
  IGHA1  CDR3 amino acids
CARTNFGSGGYILGDTTMVWTS

SEQ ID NO: 901 - protein, 13 aa, Homo sapiens
  IGHA1  CDR3 amino acids
CARSAGYLHRRTS

SEQ ID NO: 902 - protein, 16 aa, Homo sapiens
  IGHA1  CDR3 amino acids
CARRTYYSGSTNFDYW

SEQ ID NO: 903 - protein, 18 aa, Homo sapiens
  IGHA1  CDR3 amino acids
CARRDLPFGASLSTTLTS

SEQ ID NO: 904 - protein, 14 aa, Homo sapiens
  IGHA1  CDR3 amino acids
CARPGFSYGPRLTP

SEQ ID NO: 905 - protein, 16 aa, Homo sapiens
  IGHA1  CDR3 amino acids
CARKKIPTAGYSSLTT

SEQ ID NO: 906 - protein, 16 aa, Homo sapiens
  IGHA1  CDR3 amino acids
CARGSWMGRPFISLTT

SEQ ID NO: 907 - protein, 10 aa, Homo sapiens
  IGHA1  CDR3 amino acids
CARGLRWADN

SEQ ID NO: 908 - protein, 20 aa, Homo sapiens
  IGHA1  CDR3 amino acids
CARGGTSGLILDTTSTPWTS

SEQ ID NO: 909 - protein, 19 aa, Homo sapiens
  IGHA1  CDR3 amino acids
CAREMHIDSLTVGRAFDIW

SEQ ID NO: 910 - protein, 16 aa, Homo sapiens
  IGHA1  CDR3 amino acids
CARDVPDIYSSGATDC

SEQ ID NO: 911 - protein, 15 aa, Homo sapiens
  IGHA1  CDR3 amino acids
CARDPSYLPTPALKT

SEQ ID NO: 912 - protein, 17 aa, Homo sapiens
  IGHA1  CDR3 amino acids
CARDPNKFRPNHFVDYW

SEQ ID NO: 913 - protein, 15 aa, Homo sapiens
  IGHA1  CDR3 amino acids
CARDLGTTNYWLDTW

SEQ ID NO: 914 - protein, 13 aa, Homo sapiens
  IGHA1  CDR3 amino acids
CAKQRASGNSLTI

SEQ ID NO: 915 - protein, 17 aa, Homo sapiens
  IGHA1  CDR3 amino acids
CAKEPKIVGRRRTTLIT

SEQ ID NO: 916 - protein, 20 aa, Homo sapiens
  IGHA1  CDR3 amino acids
CAKDLGVCSEGAASSLVLIS

SEQ ID NO: 917 - protein, 24 aa, Homo sapiens
  IGHA1  CDR3 amino acids
CAHSAPYYDICLVTAHEVGRILTT

SEQ ID NO: 918 - protein, 13 aa, Homo sapiens
  IGHA1  CDR3 amino acids
CAGLIGRFIPLTT

SEQ ID NO: 919 - protein, 26 aa, Homo sapiens
  IGHD2-21  CDR3 amino acids
CAKDMCGLWASCGGDCYSRRTTSLTT

SEQ ID NO: 920 - protein, 26 aa, Homo sapiens
  IGHD2-21  CDR3 amino acids
CAKDMCGLWASCGGDCYSRRTASLTT

SEQ ID NO: 921 - protein, 21 aa, Homo sapiens
  IGHD2-21  CDR3 amino acids
CARGPNMAFVVVTAILMLLIS

SEQ ID NO: 922 - protein, 23 aa, Homo sapiens
  IGHD2-21  CDR3 amino acids
CARAPDCGGSTCYSHPYYGMDVW

SEQ ID NO: 923 - protein, 23 aa, Homo sapiens
  IGHD2-21  CDR3 amino acids
CARDPRIVVVAPATHTPTTVWTS

SEQ ID NO: 924 - protein, 16 aa, Homo sapiens
  IGHD3-3  CDR3 amino acids
CIYDFWSGGPHPTLTT

SEQ ID NO: 925 - protein, 17 aa, Homo sapiens
  IGHD3-3  CDR3 amino acids
CARIVNTEGFWSGFLTP

SEQ ID NO: 926 - protein, 17 aa, Homo sapiens
  IGHD3-3  CDR3 amino acids
CARIVNTEGFGVVFLTP

SEQ ID NO: 927 - protein, 22 aa, Homo sapiens
  IGHD2-15  CDR3 amino acids
CARAPDCGGGTCYSHPTTVWTS

SEQ ID NO: 928 - protein, 22 aa, Homo sapiens
  IGHD2-15  CDR3 amino acids
CARARIVVVVPATLTPTTVWTS

SEQ ID NO: 929 - protein, 23 aa, Homo sapiens
  IGHD2-15  CDR3 amino acids
CARAPDCGGGTCYSHPYYGMDVW

SEQ ID NO: 930 - protein, 16 aa, Homo sapiens
  IGHD6-13  CDR3 amino acids
CALCPTPIAAAGSVTT

SEQ ID NO: 931 - protein, 17 aa, Homo sapiens
  IGHD6-13  CDR3 amino acids
CALCPNPYSSGWFCNYW

SEQ ID NO: 932 - protein, 18 aa, Homo sapiens
  IGHD1-26  CDR3 amino acids
CARGPATAILGATPSLTP

SEQ ID NO: 933 - protein, 18 aa, Homo sapiens
  IGHD1-26  CDR3 amino acids
CVRHDYSDNDLSTNWFGP

SEQ ID NO: 934 - protein, 18 aa, Homo sapiens
  IGHD3-10  CDR3 amino acids
CATYYYGSGSAGHNFDYW

SEQ ID NO: 935 - protein, 24 aa, Homo sapiens
  IGHD3-10  CDR3 amino acids
CARGPGLSVMIRGVITTPNHILIT

SEQ ID NO: 936 - protein, 25 aa, Homo sapiens
  IGHD2-8  CDR3 amino acids
CANVGGADRNYCINGVRHNPNYLTT

SEQ ID NO: 937 - protein, 13 aa, Homo sapiens
  IGHD3-16  CDR3 amino acids
CARGFGARGVILT

SEQ ID NO: 938 - protein, 16 aa, Homo sapiens
  IGHD5-12  CDR3 amino acids
CVLSRGLVATRTLDYW

SEQ ID NO: 939 - protein, 13 aa, Homo sapiens
  IGHD4-17  CDR3 amino acids
CARTLYGDFVDSL

SEQ ID NO: 940 - protein, 20 aa, Homo sapiens
  IGHD3-22  CDR3 amino acids
CARDKQESSGSPRNYYFDYW

SEQ ID NO: 941 - protein, 18 aa, Homo sapiens
  IGHA2  CDR3 amino acids
CAKGHQVRLRGRTGTSIS

SEQ ID NO: 942 - protein, 22 aa, Homo sapiens
  IGHA2  CDR3 amino acids
CAGAPDCGVGAAPLTSTTVCTS

SEQ ID NO: 943 - protein, 18 aa, Homo sapiens
  IGHA2  CDR3 amino acids
CAGIGGATSTTTTTTWTS

SEQ ID NO: 944 - protein, 16 aa, Homo sapiens
  IGHA2  CDR3 amino acids
CARRAAPHDYGHVLIF

SEQ ID NO: 945 - protein, 15 aa, Homo sapiens
  IGHA2  CDR3 amino acids
CVRHDGSFTKTGSTP

SEQ ID NO: 946 - protein, 8 aa, Homo sapiens
  IGHA2  CDR3 amino acids
CVKIGAAH

SEQ ID NO: 947 - protein, 25 aa, Homo sapiens
  IGHA2  CDR3 amino acids
CARLRCSNDNCAGHLYYYFSGLDIW

SEQ ID NO: 948 - protein, 13 aa, Homo sapiens
  IGHA2  CDR3 amino acids
CARASLPRGLLIS

SEQ ID NO: 949 - protein, 16 aa, Homo sapiens
  IGHA2  CDR3 amino acids
CTKGGGRKTAGKFLTP

SEQ ID NO: 950 - protein, 10 aa, Homo sapiens
  IGHA2  CDR3 amino acids
CARTARTGDL

SEQ ID NO: 951 - protein, 22 aa, Homo sapiens
  IGHA2  CDR3 amino acids
CARIGHEFYSLTYSVNDVFDLW

SEQ ID NO: 952 - protein, 16 aa, Homo sapiens
  IGHA2  CDR3 amino acids
CAKGRGRRAAGKFLTT

SEQ ID NO: 953 - protein, 16 aa, Homo sapiens
  IGHA2  CDR3 amino acids
CAKGAGRRAAGKFLTT

SEQ ID NO: 954 - protein, 20 aa, Homo sapiens
  IGHA2  CDR3 amino acids
CVRFIGAYSNNWYPGYFDYW

SEQ ID NO: 955 - protein, 16 aa, Homo sapiens
  IGHA2  CDR3 amino acids
CASQSQNYYYYYMDVW

SEQ ID NO: 956 - protein, 16 aa, Homo sapiens
  IGHA2  CDR3 amino acids
CASKKEILWAGPNLTT

SEQ ID NO: 957 - protein, 17 aa, Homo sapiens
  IGHA2  CDR3 amino acids
CARVRCGLVASEGVLIS

SEQ ID NO: 958 - protein, 16 aa, Homo sapiens
  IGHA2  CDR3 amino acids
CARRAAPMTTGMFLIF

SEQ ID NO: 959 - protein, 22 aa, Homo sapiens
  IGHA2  CDR3 amino acids
CARLRGGFPPVVKRVEVFLLTS

SEQ ID NO: 960 - protein, 16 aa, Homo sapiens
  IGHA2  CDR3 amino acids
CARGRFARGGDDSLIS

SEQ ID NO: 961 - protein, 13 aa, Homo sapiens
  IGHA2  CDR3 amino acids
CAKAPGDLCRSTP

SEQ ID NO: 962 - protein, 19 aa, Homo sapiens
  IGHA2  CDR3 amino acids
CAGIRGSNIYYHYYYMDVW

SEQ ID NO: 963 - protein, 13 aa, Homo sapiens
  IGHA2  CDR3 amino acids
CADLPGIIGGEIT

SEQ ID NO: 964 - protein, 20 aa, Homo sapiens
  IGHD3-22  CDR3 amino acids
CAKITSMIVVLIPTMMLLMS

SEQ ID NO: 965 - protein, 22 aa, Homo sapiens
  IGHD3-22  CDR3 amino acids
CARGSRARFSSDTSGYQYFDYW

SEQ ID NO: 966 - protein, 19 aa, Homo sapiens
  IGHD3-22  CDR3 amino acids
CARGVYLYYDSHAYSVLTT

SEQ ID NO: 967 - protein, 14 aa, Homo sapiens
  IGHD3-22  CDR3 amino acids
CARVNYYDSVVLTT

SEQ ID NO: 968 - protein, 15 aa, Homo sapiens
  IGHD3-22  CDR3 amino acids
CARVNYYDSSRIDYW

SEQ ID NO: 969 - protein, 21 aa, Homo sapiens
  IGHD3-22  CDR3 amino acids
CARLPPFNNDDSSSYALYLTT

SEQ ID NO: 970 - protein, 23 aa, Homo sapiens
  IGHD3-22  CDR3 amino acids
CARHSNYYYDTSGYRVLDAFDIW

SEQ ID NO: 971 - protein, 20 aa, Homo sapiens
  IGHD3-22  CDR3 amino acids
CARGGMDSYGYFYVGHYDYW

SEQ ID NO: 972 - protein, 20 aa, Homo sapiens
  IGHD3-22  CDR3 amino acids
CAKITSMIVVLTPTMMLLMS

SEQ ID NO: 973 - protein, 15 aa, Homo sapiens
  IGHD3-10  CDR3 amino acids
CARLPRMVRGNWFHP

SEQ ID NO: 974 - protein, 19 aa, Homo sapiens
  IGHD3-10  CDR3 amino acids
CARGAWAVRGVISWAGSTP

SEQ ID NO: 975 - protein, 16 aa, Homo sapiens
  IGHD3-10  CDR3 amino acids
CAGSGSGSLLTTVWTP

SEQ ID NO: 976 - protein, 20 aa, Homo sapiens
  IGHD3-10  CDR3 amino acids
CVSITNSLLWFGELLIFDCW

SEQ ID NO: 977 - protein, 18 aa, Homo sapiens
  IGHD6-13  CDR3 amino acids
CTRQEESSAAGTGGTSSP

SEQ ID NO: 978 - protein, 16 aa, Homo sapiens
  IGHD6-13  CDR3 amino acids
CALCPTPIAAAGSVTT

SEQ ID NO: 979 - protein, 21 aa, Homo sapiens
  IGHD6-13  CDR3 amino acids
CATSEGDPVAAAGTKSWFDSW

SEQ ID NO: 980 - protein, 19 aa, Homo sapiens
  IGHD6-13  CDR3 amino acids
CARLALLYGSSRYGATLTT

SEQ ID NO: 981 - protein, 15 aa, Homo sapiens
  IGHD6-13  CDR3 amino acids
CARGPSSTWYSFDYW

SEQ ID NO: 982 - protein, 23 aa, Homo sapiens
  IGHD3-3  CDR3 amino acids
CAHSVGFILDFWSGYQNNWFDPW

SEQ ID NO: 983 - protein, 18 aa, Homo sapiens
  IGHD3-3  CDR3 amino acids
CAMGPTIFGVVFLGSLTS

SEQ ID NO: 984 - protein, 23 aa, Homo sapiens
  IGHD3-3  CDR3 amino acids
CAHSVGFILDFWSGYQNNWFDPG

SEQ ID NO: 985 - protein, 22 aa, Homo sapiens
  IGHD3-3  CDR3 amino acids
CAHSVGFILDFGVVIRTTGSTP

SEQ ID NO: 986 - protein, 21 aa, Homo sapiens
  IGHD3-16  CDR3 amino acids
CVRQSPLDDVWGVFAPVGSTP

SEQ ID NO: 987 - protein, 21 aa, Homo sapiens
  IGHD3-16  CDR3 amino acids
CVRQSPLDDVWGVFAPVGSTL

SEQ ID NO: 988 - protein, 17 aa, Homo sapiens
  IGHD5-5  CDR3 amino acids
CARGVDTTMVRSTTLTT

SEQ ID NO: 989 - protein, 23 aa, Homo sapiens
  IGHD5-5  CDR3 amino acids
CARQDPYCSTSNCTMGGAMTLTT

SEQ ID NO: 990 - protein, 19 aa, Homo sapiens
  IGHD5-24  CDR3 amino acids
CARTDGIRDGYNLHRVLTT

SEQ ID NO: 991 - protein, 20 aa, Homo sapiens
  IGHD5-24  CDR3 amino acids
CARTDAIRDGYNLHRVFDYW

SEQ ID NO: 992 - protein, 20 aa, Homo sapiens
  IGHD3-9  CDR3 amino acids
CAREGRNYDSLTGDPWFDPW

SEQ ID NO: 993 - protein, 23 aa, Homo sapiens
  IGHD1-7  CDR3 amino acids
CARGDCTTINCNTHSDYYGLDVW

SEQ ID NO: 994 - protein, 16 aa, Homo sapiens
  IGHD1-7  CDR3 amino acids
CARTVGTGTTNGYLTS

SEQ ID NO: 995 - protein, 22 aa, Homo sapiens
  IGHD1-7  CDR3 amino acids
CAREIVLLSTATLTPTTTVWTS

SEQ ID NO: 996 - protein, 15 aa, Homo sapiens
  IGHD4-17  CDR3 amino acids
CARHPKPPTVTSATT

SEQ ID NO: 997 - protein, 20 aa, Homo sapiens
  IGHD5-12  CDR3 amino acids
CARQDSGYDYGYYHNGMDVW

SEQ ID NO: 998 - protein, 20 aa, Homo sapiens
  IGHD2-2  CDR3 amino acids
CARHSLAYCSTTSCAVFDYW

SEQ ID NO: 999 - protein, 27 aa, Homo sapiens
  IGHD2-2  CDR3 amino acids
CARHGFEGREVVPPAMNEYYYYYMDVW

SEQ ID NO: 1000 - protein, 18 aa, Homo sapiens
  IGHD2-15  CDR3 amino acids
CALTGLNGRSCYSELLIS

SEQ ID NO: 1001 - protein, 16 aa, Homo sapiens
  IGHD4-23  CDR3 amino acids
CARGAGYGGNSGVRTT

SEQ ID NO: 1002 - protein, 15 aa, Homo sapiens
  IGHG1  CDR3 amino acids
CARGATVGVETGSTP

SEQ ID NO: 1003 - protein, 13 aa, Homo sapiens
  IGHG1  CDR3 amino acids
CARKGSRHGGSTP

SEQ ID NO: 1004 - protein, 15 aa, Homo sapiens
  IGHG1  CDR3 amino acids
CARQNGPSIGGGSTP

SEQ ID NO: 1005 - protein, 15 aa, Homo sapiens
  IGHG1  CDR3 amino acids
CARGATPGAETGSTP

SEQ ID NO: 1006 - protein, 14 aa, Homo sapiens
  IGHG1  CDR3 amino acids
CAKDTLGGMGGLTS

SEQ ID NO: 1007 - protein, 27 aa, Homo sapiens
  IGHG1  CDR3 amino acids
CARVRVLPEGVLISLRPLGSTTITWTS

SEQ ID NO: 1008 - protein, 15 aa, Homo sapiens
  IGHG1  CDR3 amino acids
CATDRDSSWGTSLTT

SEQ ID NO: 1009 - protein, 16 aa, Homo sapiens
  IGHG1  CDR3 amino acids
CARRGGSTVTTGTSIS

SEQ ID NO: 1010 - protein, 23 aa, Homo sapiens
  IGHG1  CDR3 amino acids
CARQDPYCSTSNCTMGGAMTLTT

SEQ ID NO: 1011 - protein, 15 aa, Homo sapiens
  IGHG1  CDR3 amino acids
CAILPETQWYPRLTT

SEQ ID NO: 1012 - protein, 13 aa, Homo sapiens
  IGHG1  CDR3 amino acids
CVHRPRWLNVVPT

SEQ ID NO: 1013 - protein, 13 aa, Homo sapiens
  IGHG1  CDR3 amino acids
CVHRPRWLNVVPN

SEQ ID NO: 1014 - protein, 15 aa, Homo sapiens
  IGHG1  CDR3 amino acids
CARLGKNHSQGVDYW

SEQ ID NO: 1015 - protein, 24 aa, Homo sapiens
  IGHG1  CDR3 amino acids
CARGFMVQASSVRLKRGQFLADSW

SEQ ID NO: 1016 - protein, 14 aa, Homo sapiens
  IGHG1  CDR3 amino acids
CARGDWGTVTLATT

SEQ ID NO: 1017 - protein, 21 aa, Homo sapiens
  IGHG1  CDR3 amino acids
CARDNQPWRDARNLGGAFDVW

SEQ ID NO: 1018 - protein, 22 aa, Homo sapiens
  IGHG1  CDR3 amino acids
CARDGLRPPPFMVTIQRGGLTT

SEQ ID NO: 1019 - protein, 23 aa, Homo sapiens
  IGHG1  CDR3 amino acids
CARAVGGFNSGWPSIGVPARSTP

SEQ ID NO: 1020 - protein, 23 aa, Homo sapiens
  IGHG1  CDR3 amino acids
CARAVGGFNSGWPSIGVPARSTL

SEQ ID NO: 1021 - protein, 23 aa, Homo sapiens
  IGHG1  CDR3 amino acids
CAKSPKPWSQLVSTPIMPTPWTS

SEQ ID NO: 1022 - protein, 13 aa, Homo sapiens
  IGHG1  CDR3 amino acids
CVRESTFYYFGPW

SEQ ID NO: 1023 - protein, 26 aa, Homo sapiens
  IGHG1  CDR3 amino acids
CVRDDDYSRTWYMGQGASSDYGMDVW

SEQ ID NO: 1024 - protein, 14 aa, Homo sapiens
  IGHG1  CDR3 amino acids
CVKWVSGVLTSLTT

SEQ ID NO: 1025 - protein, 18 aa, Homo sapiens
  IGHG1  CDR3 amino acids
CATSGRSSAWYPDVFDIW

SEQ ID NO: 1026 - protein, 18 aa, Homo sapiens
  IGHG1  CDR3 amino acids
CATNYCRGISCYPAPLTT

SEQ ID NO: 1027 - protein, 13 aa, Homo sapiens
  IGHG1  CDR3 amino acids
CASMIALHHTLTS

SEQ ID NO: 1028 - protein, 15 aa, Homo sapiens
  IGHG1  CDR3 amino acids
CARYSPVDPSTLDFW

SEQ ID NO: 1029 - protein, 16 aa, Homo sapiens
  IGHG1  CDR3 amino acids
CARVLDSSAHWYFDDW

SEQ ID NO: 1030 - protein, 15 aa, Homo sapiens
  IGHG1  CDR3 amino acids
CARQNGPSIGGGSTL

SEQ ID NO: 1031 - protein, 18 aa, Homo sapiens
  IGHG1  CDR3 amino acids
CARQHSEWEILRLVFDHW

SEQ ID NO: 1032 - protein, 15 aa, Homo sapiens
  IGHG1  CDR3 amino acids
CARLPRMVRVTGSTP

SEQ ID NO: 1033 - protein, 15 aa, Homo sapiens
  IGHG1  CDR3 amino acids
CARIDYVSTWYYDQW

SEQ ID NO: 1034 - protein, 16 aa, Homo sapiens
  IGHG1  CDR3 amino acids
CARICAEREFLSLLTP

SEQ ID NO: 1035 - protein, 22 aa, Homo sapiens
  IGHG1  CDR3 amino acids
CARGDCTTINCNTHSTTTVWTS

SEQ ID NO: 1036 - protein, 15 aa, Homo sapiens
  IGHG1  CDR3 amino acids
CARGATVGVETGSTL

SEQ ID NO: 1037 - protein, 15 aa, Homo sapiens
  IGHG1  CDR3 amino acids
CARGATLGVETGWTP

SEQ ID NO: 1038 - protein, 17 aa, Homo sapiens
  IGHG1  CDR3 amino acids
CAREYYGILYGYYFDYW

SEQ ID NO: 1039 - protein, 20 aa, Homo sapiens
  IGHG1  CDR3 amino acids
CARDNQPWRDARNLGVHLMC

SEQ ID NO: 1040 - protein, 15 aa, Homo sapiens
  IGHG1  CDR3 amino acids
CARDGGLAGTGTLEY

SEQ ID NO: 1041 - protein, 16 aa, Homo sapiens
  IGHG1  CDR3 amino acids
CARAGLVLGPYGMDIW

SEQ ID NO: 1042 - protein, 24 aa, Homo sapiens
  IGHG1  CDR3 amino acids
CAKVAETLVSTGFDSYYAYSMDVW

SEQ ID NO: 1043 - protein, 18 aa, Homo sapiens
  IGHG1  CDR3 amino acids
CAKTYDYGSRGFSILLIS

SEQ ID NO: 1044 - protein, 16 aa, Homo sapiens
  IGHG1  CDR3 amino acids
CAKGAGRRAAGKFLTT

SEQ ID NO: 1045 - protein, 27 aa, Homo sapiens
  IGHG1  CDR3 amino acids
CAKAKRRSLGMQTLPTLRGRSDGFDVW

SEQ ID NO: 1046 - protein, 16 aa, Homo sapiens
  IGHG1  CDR3 amino acids
CAKADCGTGCFIVDDW

SEQ ID NO: 1047 - protein, 17 aa, Homo sapiens
  IGHD3-10  CDR3 amino acids
CARGRYAGGVIITALTP

SEQ ID NO: 1048 - protein, 21 aa, Homo sapiens
  IGHD3-10  CDR3 amino acids
CSREVGRDYYGSGVIEITWTS

SEQ ID NO: 1049 - protein, 22 aa, Homo sapiens
  IGHD3-10  CDR3 amino acids
CSREVGRDYYGSGSYRNYMDVW

SEQ ID NO: 1050 - protein, 20 aa, Homo sapiens
  IGHD2-15  CDR3 amino acids
CAKKEFILVVVITMMSLLMS

SEQ ID NO: 1051 - protein, 14 aa, Homo sapiens
  IGHD2-15  CDR3 amino acids
CAKDMTAKACSDYW

SEQ ID NO: 1052 - protein, 20 aa, Homo sapiens
  IGHD2-15  CDR3 amino acids
CARVMGCRGGRCDFRAFDIW

SEQ ID NO: 1053 - protein, 16 aa, Homo sapiens
  IGHD2-15  CDR3 amino acids
CARRFCSGGICYFLTT

SEQ ID NO: 1054 - protein, 21 aa, Homo sapiens
  IGHD2-15  CDR3 amino acids
CAKEGVYFSGGNHYDVAFNVW

SEQ ID NO: 1055 - protein, 15 aa, Homo sapiens
  IGHD6-25  CDR3 amino acids
CARVKGGIAGMAWTS

SEQ ID NO: 1056 - protein, 14 aa, Homo sapiens
  IGHD6-19  CDR3 amino acids
CARDLGSGWFRFDP

SEQ ID NO: 1057 - protein, 14 aa, Homo sapiens
  IGHD6-19  CDR3 amino acids
CARDLGSGWFGSTP

SEQ ID NO: 1058 - protein, 17 aa, Homo sapiens
  IGHD3-3  CDR3 amino acids
CARPSRCCYSGGGRLTL

SEQ ID NO: 1059 - protein, 17 aa, Homo sapiens
  IGHD3-3  CDR3 amino acids
CARPSRCCYVRGGRLTL

SEQ ID NO: 1060 - protein, 18 aa, Homo sapiens
  IGHD5-24  CDR3 amino acids
CARGKRDAYNYYSHLDSW

SEQ ID NO: 1061 - protein, 17 aa, Homo sapiens
  IGHD5-24  CDR3 amino acids
CARGKEMPTITTLILTP

SEQ ID NO: 1062 - protein, 15 aa, Homo sapiens
  IGHD4-17  CDR3 amino acids
CAKGENTVTTGQEYW

SEQ ID NO: 1063 - protein, 14 aa, Homo sapiens
  IGHD4-17  CDR3 amino acids
CAKGENTVTTGQEY

SEQ ID NO: 1064 - protein, 7 aa, Homo sapiens
  IGHD3-22  CDR3 amino acids
CARDPDF

SEQ ID NO: 1065 - protein, 23 aa, Homo sapiens
  IGHD2-8  CDR3 amino acids
CAKSHHCTNGVCHPPRFGQRSTP

SEQ ID NO: 1066 - protein, 23 aa, Homo sapiens
  IGHD2-2  CDR3 amino acids
CASRYCTSDRCLGASGKPSFDTW

SEQ ID NO: 1067 - protein, 17 aa, Homo sapiens
  IGHG2  CDR3 amino acids
CARGGPKKVVTAAHLSP

SEQ ID NO: 1068 - protein, 14 aa, Homo sapiens
  IGHG2  CDR3 amino acids
CSTLGLGPPGGQTT

SEQ ID NO: 1069 - protein, 17 aa, Homo sapiens
  IGHG2  CDR3 amino acids
CARDHYDTRGVRMLLIS

SEQ ID NO: 1070 - protein, 23 aa, Homo sapiens
  IGHG2  CDR3 amino acids
CARMVRGGGRTSSGYYYYYMDVW

SEQ ID NO: 1071 - protein, 15 aa, Homo sapiens
  IGHG2  CDR3 amino acids
CARDGVWDLPTTLTT

SEQ ID NO: 1072 - protein, 23 aa, Homo sapiens
  IGHG2  CDR3 amino acids
CTMATVGHGLRRCFGKSTATLTS

SEQ ID NO: 1073 - protein, 19 aa, Homo sapiens
  IGHG2  CDR3 amino acids
CVRMGPPCQLAGRSSSLTS

SEQ ID NO: 1074 - protein, 14 aa, Homo sapiens
  IGHG2  CDR3 amino acids
CSTLGLGPPGGLTT

SEQ ID NO: 1075 - protein, 9 aa, Homo sapiens
  IGHG2  CDR3 amino acids
CMGPGETAI

SEQ ID NO: 1076 - protein, 17 aa, Homo sapiens
  IGHG2  CDR3 amino acids
CARVSMIRFRVWGLWTS

SEQ ID NO: 1077 - protein, 14 aa, Homo sapiens
  IGHG2  CDR3 amino acids
CARVQRGAVVIPTT

SEQ ID NO: 1078 - protein, 18 aa, Homo sapiens
  IGHG2  CDR3 amino acids
CARRRYNDLGAPNWVDPW

SEQ ID NO: 1079 - protein, 22 aa, Homo sapiens
  IGHG2  CDR3 amino acids
CARGEDCGGGRCNNLPTTVWTS

SEQ ID NO: 1080 - protein, 17 aa, Homo sapiens
  IGHG2  CDR3 amino acids
CAKRKLAPPRKFTTLTT

SEQ ID NO: 1081 - protein, 22 aa, Homo sapiens
  IGHG2  CDR3 amino acids
CATLEGGAPPDLRRAEAFLLIS

SEQ ID NO: 1082 - protein, 23 aa, Homo sapiens
  IGHG2  CDR3 amino acids
CARGKDCGGGRCNNVPYYGMDVW

SEQ ID NO: 1083 - protein, 16 aa, Homo sapiens
  IGHG2  CDR3 amino acids
CAKDGHKLTGTTTRTS

SEQ ID NO: 1084 - protein, 15 aa, Homo sapiens
  IGHG2  CDR3 amino acids
CVRDLGAITPVFSTS

SEQ ID NO: 1085 - protein, 20 aa, Homo sapiens
  IGHG2  CDR3 amino acids
CARSFVVKVHAHCGAVLSST

SEQ ID NO: 1086 - protein, 21 aa, Homo sapiens
  IGHG2  CDR3 amino acids
CARRLNVAVVVPAYVGWFDPW

SEQ ID NO: 1087 - protein, 22 aa, Homo sapiens
  IGHG2  CDR3 amino acids
CARGKDCGGGRCNNVPTTGWTS

SEQ ID NO: 1088 - protein, 16 aa, Homo sapiens
  IGHG2  CDR3 amino acids
CARDWEWQQRLNYFDP

SEQ ID NO: 1089 - protein, 14 aa, Homo sapiens
  IGHG2  CDR3 amino acids
CVRRAAGGRSGLTT

SEQ ID NO: 1090 - protein, 16 aa, Homo sapiens
  IGHG2  CDR3 amino acids
CVRPPPTVPGTAGSTP

SEQ ID NO: 1091 - protein, 12 aa, Homo sapiens
  IGHG2  CDR3 amino acids
CVALFVPAGSTL

SEQ ID NO: 1092 - protein, 24 aa, Homo sapiens
  IGHG2  CDR3 amino acids
CTMATVGHGATTLFREVHRNTDFW

SEQ ID NO: 1093 - protein, 14 aa, Homo sapiens
  IGHG2  CDR3 amino acids
CSTLGLGPRGADYW

SEQ ID NO: 1094 - protein, 11 aa, Homo sapiens
  IGHG2  CDR3 amino acids
CSRTGGRLLIS

SEQ ID NO: 1095 - protein, 12 aa, Homo sapiens
  IGHG2  CDR3 amino acids
CSKVGRILKLIT

SEQ ID NO: 1096 - protein, 11 aa, Homo sapiens
  IGHG2  CDR3 amino acids
CKVAVEMVLMY

SEQ ID NO: 1097 - protein, 12 aa, Homo sapiens
  IGHG2  CDR3 amino acids
CGKFLGTTVASS

SEQ ID NO: 1098 - protein, 22 aa, Homo sapiens
  IGHG2  CDR3 amino acids
CATLTGGAPPDLRRAEAFLLIS

SEQ ID NO: 1099 - protein, 14 aa, Homo sapiens
  IGHG2  CDR3 amino acids
CATEGTGAVTPFTT

SEQ ID NO: 1100 - protein, 11 aa, Homo sapiens
  IGHG2  CDR3 amino acids
CATAPGGTSYT

SEQ ID NO: 1101 - protein, 14 aa, Homo sapiens
  IGHG2  CDR3 amino acids
CASRPSWGSSFDFW

SEQ ID NO: 1102 - protein, 13 aa, Homo sapiens
  IGHG2  CDR3 amino acids
CASRPPGAAALTS

SEQ ID NO: 1103 - protein, 17 aa, Homo sapiens
  IGHG2  CDR3 amino acids
CARRRYNDLGAPTGSTP

SEQ ID NO: 1104 - protein, 22 aa, Homo sapiens
  IGHG2  CDR3 amino acids
CARMVREEAERRPAIIITTWTS

SEQ ID NO: 1105 - protein, 17 aa, Homo sapiens
  IGHG2  CDR3 amino acids
CARGPGWGMGSTKFDCW

SEQ ID NO: 1106 - protein, 16 aa, Homo sapiens
  IGHG2  CDR3 amino acids
CARGPGGVWDRLSLTS

SEQ ID NO: 1107 - protein, 20 aa, Homo sapiens
  IGHG2  CDR3 amino acids
CARGGKSATGANYHQFFDCW

SEQ ID NO: 1108 - protein, 17 aa, Homo sapiens
  IGHG2  CDR3 amino acids
CARDWEWQQRLNYFDPW

SEQ ID NO: 1109 - protein, 16 aa, Homo sapiens
  IGHG2  CDR3 amino acids
CARDHYYDERNQGPDW

SEQ ID NO: 1110 - protein, 12 aa, Homo sapiens
  IGHG2  CDR3 amino acids
CARAGGHGTWTS

SEQ ID NO: 1111 - protein, 15 aa, Homo sapiens
  IGHG2  CDR3 amino acids
CAKSLRVGGDVFEIW

SEQ ID NO: 1112 - protein, 9 aa, Homo sapiens
  IGHG2  CDR3 amino acids
CAKSDYFDP

SEQ ID NO: 1113 - protein, 17 aa, Homo sapiens
  IGHG2  CDR3 amino acids
CAKGRGRLVTIATTLTT

SEQ ID NO: 1114 - protein, 17 aa, Homo sapiens
  IGHG2  CDR3 amino acids
CAKAHFPGDLPSFSSIS

SEQ ID NO: 1115 - protein, 16 aa, Homo sapiens
  IGHG2  CDR3 amino acids
CAHQQWRPGRRGFDYW

SEQ ID NO: 1116 - DNA, 35 bp, artificial sequence; identical to SEQ ID NO: 1
  BSL-18E  primer
  misc_feature (35)..(35): n is a, c, g, t or u

SEQ ID NO: 1117 - DNA, 20 bp, artificial sequence
  P20EA  primer
taatacgactccgaattccc

SEQ ID NO: 1118 - DNA, 10 bp, artificial sequence
  P10EA  primer
gggaattcgg

SEQ ID NO: 1119 - DNA, 23 bp, artificial sequence
  CA1 primer
tgttgaaggcgtttgcacatgca

SEQ ID NO: 1120 - DNA, 23 bp, artificial sequence
  CA2  primer
gtgcatagacctcatgtctagca

SEQ ID NO: 1121 - DNA, 18 bp, artificial sequence
  TRAC-3ter-1st  primer
cagcgtcatgagcagatt

SEQ ID NO: 1122 - DNA, 18 bp, artificial sequence
  TRAC-3ter-2nd  primer
actttcaggaggaggatt

SEQ ID NO: 1123 - DNA, 23 bp, artificial sequence
  CB1  primer
gaactggacttgacagcggaact

SEQ ID NO: 1124 - DNA, 23 bp, artificial sequence
  CB2  primer
aggcagtatctggagtcattgag

SEQ ID NO: 1125 - DNA, 18 bp, artificial sequence
  TRBC-Center-1st  primer
acagtctgctctacccca

SEQ ID NO: 1126 - DNA, 18 bp, artificial sequence
  TRBC-Center-2nd  primer
gtccactcgtcattctcc

SEQ ID NO: 1127 - DNA, 18 bp, artificial sequence
  TRBC-3ter-1st  primer
gaatcctttctcttgacc

SEQ ID NO: 1128 - DNA, 20 bp, artificial sequence
  TRBC-3ter-2nd  primer
ttccctagcaagatctcata

SEQ ID NO: 1129 - DNA, 19 bp, artificial sequence
  CM1  primer
tcctgtgcgaggcagccaa

SEQ ID NO: 1130 - DNA, 20 bp, artificial sequence
  CM2  primer
gtatccgacggggaattctc

SEQ ID NO: 1131 - DNA, 20 bp, artificial sequence
  IGHM-Cent-1st  primer
gatgttggtgtgggttttca

SEQ ID NO: 1132 - DNA, 20 bp, artificial sequence
  IGHM-Cent-2nd  primer
ataggtggtcaggtctgtga

SEQ ID NO: 1133 - DNA, 20 bp, artificial sequence
  IGHM-3ter-1st  primer
tagaagaggctcaggaggaa

SEQ ID NO: 1134 - DNA, 20 bp, artificial sequence
  IGHM-3ter-2nd  primer
ttccattcctcttcggacac

SEQ ID NO: 1135 - DNA, 20 bp, artificial sequence
  CA1  primer
gctggctgctcgtggtgtac

SEQ ID NO: 1136 - DNA, 21 bp, artificial sequence
  CA2  primer
gggaagtttctggcggtcacg

SEQ ID NO: 1137 - DNA, 20 bp, artificial sequence
  IGHA-Cent-1st  primer
gaatgtgtttccggattttg

SEQ ID NO: 1138 - DNA, 18 bp, artificial sequence
  IGHA-Cent-2nd  primer
tagcagccacagaggtca

SEQ ID NO: 1139 - DNA, 20 bp, artificial sequence
  IGHA-3ter-1st  primer
gccatgacaacagacacatt

SEQ ID NO: 1140 - DNA, 19 bp, artificial sequence
  IGHA-3ter-2nd  primer
ggtcgatggtcttctgtgt

SEQ ID NO: 1141 - DNA, 21 bp, artificial sequence
  CG1  primer
caccttggtgttgctgggctt

SEQ ID NO: 1142 - DNA, 21 bp, artificial sequence
  CG2  primer
tcctgaggactgtaggacagc

SEQ ID NO: 1143 - DNA, 19 bp, artificial sequence
  IGHG-Cent-1st  primer
gaccttgcacttgtactcc

SEQ ID NO: 1144 - DNA, 20 bp, artificial sequence
  IGHG-Cent-2nd  primer
ggctttgtcttggcattatg

SEQ ID NO: 1145 - DNA, 20 bp, artificial sequence
  IGHG-3ter-1st  primer
ctgtagaggaagaaggagcc

SEQ ID NO: 1146 - DNA, 19 bp, artificial sequence
  IGHG-3ter-2nd  primer
ttgtagttgttctccggct

SEQ ID NO: 1147 - DNA, 20 bp, artificial sequence
  CD1  primer
gtcccgtctttgtatctcag

SEQ ID NO: 1148 - DNA, 18 bp, artificial sequence
  CD2  primer
tctgtgtccccatgtacc

SEQ ID NO: 1149 - DNA, 20 bp, artificial sequence
  IGHD-Cent-1st  primer
tctttgtctctctctcttct

SEQ ID NO: 1150 - DNA, 20 bp, artificial sequence
  IGHD-Cent-2nd  primer
cctctttctccttctccttc

SEQ ID NO: 1151 - DNA, 20 bp, artificial sequence
  IGHD-3ter-1st  primer
tagaggagggtgaggatgaa

SEQ ID NO: 1152 - DNA, 20 bp, artificial sequence
  IGHD-3ter-2nd  primer
tcatcaaaggtcgtgtagtc

SEQ ID NO: 1153 - DNA, 18 bp, artificial sequence
  CE1  primer
catagtgaccagagagcg

SEQ ID NO: 1154 - DNA, 19 bp, artificial sequence
  CE2  primer
gtggctggtaaggtcatag

SEQ ID NO: 1155 - DNA, 19 bp, artificial sequence
  IGHE-Cent-1st  primer
tgcttctcctcctttctgg

SEQ ID NO: 1156 - DNA, 20 bp, artificial sequence
  IGHE-Cent-2nd  primer
gaatctgcacacttcttggt

SEQ ID NO: 1157 - DNA, 20 bp, artificial sequence
  IGHE-3ter-1st  primer
tcatctttctgctcccattc

SEQ ID NO: 1158 - DNA, 18 bp, artificial sequence
  IGHE-3ter-2nd  primer
ctgaagacgaagaagccg

SEQ ID NO: 1159 - DNA, 19 bp, artificial sequence
  CK1  primer
ttgtgtttctcgtagtctg

SEQ ID NO: 1160 - DNA, 18 bp, artificial sequence
  CK2  primer
ctgtactttggcctctct

SEQ ID NO: 1161 - DNA, 19 bp, artificial sequence
  CL1  primer
tgtcttctccacggtgctc

SEQ ID NO: 1162 - DNA, 16 bp, artificial sequence
  CL2  primer
ccgggtagaagtcact

SEQ ID NO: 1163 - protein, 17 aa, Homo sapiens
  TRBV20-1(BV) and TRBJ2-1(BJ)  CDR3 amino acids
CSARESTSDPKNEQFFG

SEQ ID NO: 1164 - protein, 16 aa, Homo sapiens
  TRBV10-3(BV) and TRBJ2-5(BJ)  CDR3 amino acids
CAISEPTGIRRDPVLR

SEQ ID NO: 1165 - protein, 16 aa, Homo sapiens
  TRBV10-3(TRBV) and TRBJ2-5(TRBJ)  CDR3 amino acids
CAISEPTGIRRDPVLR

SEQ ID NO: 1166 - protein, 17 aa, Homo sapiens
  TRBV20-1(TRBV) and TRBJ2-1(TRBJ)  CDR3 amino acids
CSARESTSDPKNEQFFG

SEQ ID NO: 1167 - protein, 17 aa, Homo sapiens
  TRBV20-1(TRBV)  and TRBJ2-1(TRBJ)  CDR3 amino acids
CSARESTSDTKNEQFFG

SEQ ID NO: 1168 - protein, 17 aa, Homo sapiens
  TRBV20/OR9-2(TRBV) and TRBJ2-1(TRBJ)  CDR3 amino acids
CSARESTSDTKNEQFFG

SEQ ID NO: 1169 - protein, 16 aa, Homo sapiens
  TRBV20-1(TRBV) and TRBJ2-1(TRBJ)  CDR3 amino acids
CSARESTSDTKMSSSS

SEQ ID NO: 1170 - protein, 16 aa, Homo sapiens
  TRBV4-2(TRBV) and TRBJ2-1(TRBJ)  CDR3 amino acids
CASSQTSGYGNEQFFG

SEQ ID NO: 1171 - protein, 16 aa, Homo sapiens
  TRBV10-3(TRBV) and TRBJ2-5(TRBJ)  CDR3 amino acids
CAISEPTGIRRDPVLG

SEQ ID NO: 1172 - protein, 15 aa, Homo sapiens
  TRBV10-3(TRBV) and TRBJ2-7(TRBJ)  CDR3 amino acids
CAIRGGSDSYEQYFG

SEQ ID NO: 1173 - protein, 15 aa, Homo sapiens
  TRBV19(TRBV) and TRBJ1-5(TRBJ)  CDR3 amino acids
CASSRGQGDQPQHFG

SEQ ID NO: 1174 - protein, 16 aa, Homo sapiens
  TRBV9(TRBV) and TRBJ2-1(TRBJ)  CDR3 amino acids
CASSEEQGWYNEQFFG

SEQ ID NO: 1175 - protein, 13 aa, Homo sapiens
  TRBV20/OR9-2(TRBV) and TRBJ1-2(TRBJ)  CDR3 amino acids
CSARKDSGGYTFG

SEQ ID NO: 1176 - protein, 16 aa, Homo sapiens
  TRBV10-3(TRBV) and TRBJ2-5(TRBJ)  CDR3 amino acids
CAISERQGSEETQYFG

SEQ ID NO: 1177 - protein, 15 aa, Homo sapiens
  TRBV12-4(TRBV) and TRBJ1-5(TRBJ)  CDR3 amino acids
CASSLTGENQPQHFG

SEQ ID NO: 1178 - protein, 17 aa, Homo sapiens
  TRBV12-4(TRBV) and TRBJ2-5(TRBJ)  CDR3 amino acids
CASSFDRLAGGETQYFG

SEQ ID NO: 1179 - protein, 16 aa, Homo sapiens
  TRBV20/OR9-2(TRBV) and TRBJ2-1(TRBJ)  CDR3 amino acids
CSARESTSDTKMSSSS

SEQ ID NO: 1180 - protein, 14 aa, Homo sapiens
  TRBV3-1(TRBV) and TRBJ2-3(TRBJ)  CDR3 amino acids
CASSRIGGDTQYFG

SEQ ID NO: 1181 - protein, 15 aa, Homo sapiens
  TRBV5-6(TRBV) and TRBJ1-1(TRBJ)  CDR3 amino acids
CASSLRDRDTEAFFG

SEQ ID NO: 1182 - protein, 17 aa, Homo sapiens
  TRBV6-1(TRBV) and TRBJ2-5(TRBJ)  CDR3 amino acids
CASSEDWGPYQETQYFG

SEQ ID NO: 1183 - protein, 16 aa, Homo sapiens
  TRBV10-3(TRBV) and TRBJ2-5(TRBJ)  CDR3 amino acids
CAISEPTGDQKRPSTS

SEQ ID NO: 1184 - protein, 16 aa, Homo sapiens
  TRBV10-3(TRBV) and TRBJ2-5(TRBJ)  CDR3 amino acids
CAISEPTGIRRDPSTS

SEQ ID NO: 1185 - protein, 16 aa, Homo sapiens
  TRBV10-3(TRBV) and TRBJ2-5(TRBJ)  CDR3 amino acids
CAISEPTGIRRDPVRS

SEQ ID NO: 1186 - protein, 16 aa, Homo sapiens
  TRBV18(TRBV) and TRBJ1-4(TRBJ)  CDR3 amino acids
CASSPGQGEDEKLFFG

SEQ ID NO: 1187 - protein, 16 aa, Homo sapiens
  TRBV20-1(TRBV) and TRBJ2-1(TRBJ)  CDR3 amino acids
CSARESTSDPKMSSLR

SEQ ID NO: 1188 - protein, 16 aa, Homo sapiens
  TRBV20-1(TRBV) and TRBJ2-1(TRBJ)  CDR3 amino acids
CSARGSTSDPKMSSSS

SEQ ID NO: 1189 - protein, 16 aa, Homo sapiens
  TRBV20-1(TRBV) and TRBJ2-5(TRBJ)  CDR3 amino acids
CSARESTSDPKMSSSS

SEQ ID NO: 1190 - protein, 17 aa, Homo sapiens
  TRBV20/OR9-2(TRBV) and TRBJ2-1(TRBJ)  CDR3 amino acids
  misc_feature (14)..(14): Xaa can be any naturally occurring amino acid
CSARESTSDTKNEXFFG

SEQ ID NO: 1191 - protein, 14 aa, Homo sapiens
  TRBV25-1(TRBV) and TRBJ1-1(TRBJ)  CDR3 amino acids
CASTDTLNTEAFFG

SEQ ID NO: 1192 - protein, 19 aa, Homo sapiens
  TRBV28(TRBV) and TRBJ2-3(TRBJ)  CDR3 amino acids
CASSSPGQGGSGRDTQYFG

SEQ ID NO: 1193 - protein, 13 aa, Homo sapiens
  TRBV7-9(TRBV) and TRBJ2-1(TRBJ)  CDR3 amino acids
CASSLTGNEQFFG

SEQ ID NO: 1194 - protein, 15 aa, Homo sapiens
  TRBV10-2(TRBV) and TRBJ1-5(TRBJ)  CDR3 amino acids
CASSDRDSNQPQHFG

SEQ ID NO: 1195 - protein, 15 aa, Homo sapiens
  TRBV10-3(TRBV) and TRBJ2-1(TRBJ)  CDR3 amino acids
CAIRGGSDSYEQFFG

SEQ ID NO: 1196 - protein, 15 aa, Homo sapiens
  TRBV15(TRBV) and TRBJ1-5(TRBJ)  CDR3 amino acids
CATSTPDRPPAPSIL

SEQ ID NO: 1197 - protein, 18 aa, Homo sapiens
  TRBV15(TRBV) and TRBJ2-3(TRBJ)  CDR3 amino acids
CATSRDTLAEGPKIRSIL

SEQ ID NO: 1198 - protein, 13 aa, Homo sapiens
  TRBV18(TRBV) and TRBJ1-1(TRBJ)  CDR3 amino acids
CASSPQGEEAFLD

SEQ ID NO: 1199 - protein, 16 aa, Homo sapiens
  TRBV18(TRBV) and TRBJ2-7(TRBJ)  CDR3 amino acids
CASSPDAGGILRAVLR

SEQ ID NO: 1200 - protein, 15 aa, Homo sapiens
  TRBV28(TRBV) and TRBJ1-2(TRBJ)  CDR3 amino acids
CASSLLRDRDGYTFG

SEQ ID NO: 1201 - protein, 15 aa, Homo sapiens
  TRBV28(TRBV) and TRBJ1-2(TRBJ)  CDR3 amino acids
CASSLMVPVYGYTFG

SEQ ID NO: 1202 - protein, 15 aa, Homo sapiens
  TRBV9(TRBV) and TRBJ2-7(TRBJ)  CDR3 amino acids
CASSAAGGPYEQYFG

SEQ ID NO: 1203 - protein, 16 aa, Homo sapiens
  TRBV29-1(TRBV) and TRBJ2-6(TRBJ)  CDR3 amino acids
CSAVITKSGANVLTFG

SEQ ID NO: 1204 - protein, 14 aa, Homo sapiens
  TRBV3-1(TRBV) and TRBJ2-5(TRBJ)  CDR3 amino acids
CASSQARQETQYFG

SEQ ID NO: 1205 - protein, 17 aa, Homo sapiens
  TRBV20-1(TRBV) and TRBJ2-1(TRBJ)  CDR3 amino acids
CSARESTSDPKNEQFFG

SEQ ID NO: 1206 - protein, 16 aa, Homo sapiens
  TRBV10-3(TRBV) and TRBJ2-5(TRBJ)  CDR3 amino acids
CAISEPTGIRRDPVLR

SEQ ID NO: 1207 - protein, 16 aa, Homo sapiens
  TRBV20-1(TRBV) and TRBJ1-5(TRBJ)  CDR3 amino acids
CSASRDENSNQPQHFG

SEQ ID NO: 1208 - protein, 16 aa, Homo sapiens
  TRBV7-7(TRBV) and TRBJ2-5(TRBJ)  CDR3 amino acids
CASSFLTSGSETQYFG

SEQ ID NO: 1209 - protein, 18 aa, Homo sapiens
  TRBV28(TRBV) and TRBJ2-7(TRBJ)  CDR3 amino acids
CASSPTGVGTSSYEQYFG

SEQ ID NO: 1210 - protein, 17 aa, Homo sapiens
  TRBV20-1(TRBV) and TRBJ2-1(TRBJ)  CDR3 amino acids
CSARESTSDTKNEQFFG

SEQ ID NO: 1211 - protein, 16 aa, Homo sapiens
  TRBV15(TRBV) and TRBJ1-2(TRBJ)  CDR3 amino acids
CATSRVSRQGYGYTFG

SEQ ID NO: 1212 - protein, 16 aa, Homo sapiens
  TRBV7-3(TRBV) and TRBJ2-1(TRBJ)  CDR3 amino acids
CASSPTGTRGEKQFFG

SEQ ID NO: 1213 - protein, 15 aa, Homo sapiens
  TRBV20-1(TRBV) and TRBJ1-5(TRBJ)  CDR3 amino acids
CSASRDEIAISPSIL

SEQ ID NO: 1214 - protein, 13 aa, Homo sapiens
  TRBV6-5(TRBV) and TRBJ1-2(TRBJ)  CDR3 amino acids
CASRTGDYGYTFG

SEQ ID NO: 1215 - protein, 16 aa, Homo sapiens
  TRBV4-1(TRBV) and TRBJ2-7(TRBJ)  CDR3 amino acids
CASSHTGGRVYEQYFG

SEQ ID NO: 1216 - protein, 15 aa, Homo sapiens
  TRBV5-6(TRBV) and TRBJ2-7(TRBJ)  CDR3 amino acids
CASSLVGDSYEQYFG

SEQ ID NO: 1217 - protein, 18 aa, Homo sapiens
  TRBV6-3(TRBV) and TRBJ2-7(TRBJ)  CDR3 amino acids
CASSYRLDSEGLYEQYFG

SEQ ID NO: 1218 - protein, 15 aa, Homo sapiens
  TRBV7-2(TRBV) and TRBJ2-7(TRBJ)  CDR3 amino acids
CASSIAGGPYEQYFG

SEQ ID NO: 1219 - protein, 13 aa, Homo sapiens
  TRBV29-1(TRBV) and TRBJ2-1(TRBJ)  CDR3 amino acids
CSVDGPYNEQFFG

SEQ ID NO: 1220 - protein, 19 aa, Homo sapiens
  TRBV15(TRBV) and TRBJ2-3(TRBJ)  CDR3 amino acids
CATSRDTLAGGPEDTQYFG

SEQ ID NO: 1221 - protein, 16 aa, Homo sapiens
  TRBV7-9(TRBV) and TRBJ2-3(TRBJ)  CDR3 amino acids
CASSLVAGGVDTQYFG

SEQ ID NO: 1222 - protein, 14 aa, Homo sapiens
  TRBV28(TRBV) and TRBJ2-5(TRBJ)  CDR3 amino acids
CASSLSGWETQYFG

SEQ ID NO: 1223 - protein, 20 aa, Homo sapiens
  TRBV29-1(TRBV) and TRBJ2-1(TRBJ)  CDR3 amino acids
CSVGHGWREIERSYNEQFFG

SEQ ID NO: 1224 - protein, 13 aa, Homo sapiens
  TRBV5-6(TRBV) and TRBJ2-7(TRBJ)  CDR3 amino acids
CASSLSSYEQYFG

SEQ ID NO: 1225 - protein, 15 aa, Homo sapiens
  TRBV28(TRBV) and TRBJ2-3(TRBJ)  CDR3 amino acids
CASSLTGGADTQYFG

SEQ ID NO: 1226 - protein, 15 aa, Homo sapiens
  TRBV7-3(TRBV) and TRBJ2-1(TRBJ)  CDR3 amino acids
CASSPPGREGRSSSS

SEQ ID NO: 1227 - protein, 16 aa, Homo sapiens
  TRBV10-3(TRBV) and TRBJ2-5(TRBJ)  CDR3 amino acids
CAISEPTGDQKRPSTS

SEQ ID NO: 1228 - protein, 12 aa, Homo sapiens
  TRBV2(TRBV) and TRBJ1-1(TRBJ)  CDR3 amino acids
CASSRAVEAFFG

SEQ ID NO: 1229 - protein, 18 aa, Homo sapiens
  TRBV6-1(TRBV) and TRBJ2-7(TRBJ)  CDR3 amino acids
CASSEDGLAEISYEQYFG

SEQ ID NO: 1230 - protein, 14 aa, Homo sapiens
  TRBV29-1(TRBV) and TRBJ2-7(TRBJ)  CDR3 amino acids
CSVGVSGGYEQYFG

SEQ ID NO: 1231 - protein, 20 aa, Homo sapiens
  TRBV4-1(TRBV) and TRBJ1-6(TRBJ)  CDR3 amino acids
CASSQDLRGWTGVNSPLHFG

SEQ ID NO: 1232 - protein, 18 aa, Homo sapiens
  TRBV5-8(TRBV) and TRBJ2-2(TRBJ)  CDR3 amino acids
CASSLDNRFGGTGELFLE

SEQ ID NO: 1233 - protein, 17 aa, Homo sapiens
  TRBV7-4(TRBV) and TRBJ2-7(TRBJ)  CDR3 amino acids
CASSSNRAGALPTSSTS

SEQ ID NO: 1234 - protein, 14 aa, Homo sapiens
  TRBV12-4(TRBV) and TRBJ1-5(TRBJ)  CDR3 amino acids
CASSPGGGQPQHFG

SEQ ID NO: 1235 - protein, 16 aa, Homo sapiens
  TRBV7-2(TRBV) and TRBJ2-7(TRBJ)  CDR3 amino acids
CASSSATGDLYEQYFG

SEQ ID NO: 1236 - protein, 15 aa, Homo sapiens
  TRBV7-9(TRBV) and TRBJ2-2(TRBJ)  CDR3 amino acids
CASSPTRNTGELFLE

SEQ ID NO: 1237 - protein, 14 aa, Homo sapiens
  TRBV29-1(TRBV) and TRBJ2-2(TRBJ)  CDR3 amino acids
CSARDSNTGELFLE

SEQ ID NO: 1238 - protein, 15 aa, Homo sapiens
  TRBV7-9(TRBV) and TRBJ2-2(TRBJ)  CDR3 amino acids
CASSPTRNTGELFFG

SEQ ID NO: 1239 - protein, 16 aa, Homo sapiens
  TRBV12-4(TRBV) and TRBJ2-6(TRBJ)  CDR3 amino acids
CASSRTGFGANVLTFG

SEQ ID NO: 1240 - protein, 15 aa, Homo sapiens
  TRBV18(TRBV) and TRBJ1-4(TRBJ)  CDR3 amino acids
CASSGGESLNENCFL

SEQ ID NO: 1241 - protein, 17 aa, Homo sapiens
  TRBV20/OR9-2(TRBV) and TRBJ2-1(TRBJ)  CDR3 amino acids
CSARESTSDTKNEQFFG

SEQ ID NO: 1242 - protein, 17 aa, Homo sapiens
  TRBV20/OR9-2(TRBV) and TRBJ2-1(TRBJ)  CDR3 amino acids
CSARESTSESKNEQFFG

SEQ ID NO: 1243 - protein, 16 aa, Homo sapiens
  TRBV27(TRBV) and TRBJ2-1(TRBJ)  CDR3 amino acids
CASSRAGRGLNEQFFG

SEQ ID NO: 1244 - protein, 15 aa, Homo sapiens
  TRBV7-2(TRBV) and TRBJ2-5(TRBJ)  CDR3 amino acids
CASSVINGGETQYFG

SEQ ID NO: 1245 - protein, 12 aa, Homo sapiens
  TRBV29-1(TRBV) and TRBJ2-3(TRBJ)  CDR3 amino acids
CSVSSTDTQYFG

SEQ ID NO: 1246 - protein, 18 aa, Homo sapiens
  TRBV19(TRBV) and TRBJ2-5(TRBJ)  CDR3 amino acids
CASSWGLAVGYQETQYFG

SEQ ID NO: 1247 - protein, 17 aa, Homo sapiens
  TRBV4-2(TRBV) and TRBJ2-1(TRBJ)  CDR3 amino acids
CASSQDQILPYNEQFFG

SEQ ID NO: 1248 - protein, 16 aa, Homo sapiens
  TRBV19(TRBV) and TRBJ2-1(TRBJ)  CDR3 amino acids
CASGHTGSAYNEQFFG

SEQ ID NO: 1249 - protein, 17 aa, Homo sapiens
  TRBV20-1(TRBV) and TRBJ2-1(TRBJ)  CDR3 amino acids
CSARESTSDPKNEQFFG

SEQ ID NO: 1250 - protein, 15 aa, Homo sapiens
  TRBV29-1(TRBV) and TRBJ2-5(TRBJ)  CDR3 amino acids
CSVEAKEGLRTQYFG

SEQ ID NO: 1251 - protein, 14 aa, Homo sapiens
  TRBV7-3(TRBV) and TRBJ1-6(TRBJ)  CDR3 amino acids
CASSLNRGSPLHFG

SEQ ID NO: 1252 - protein, 17 aa, Homo sapiens
  TRBV4-1(TRBV) and TRBJ2-5(TRBJ)  CDR3 amino acids
CASSKPGLAVQETQYFG

SEQ ID NO: 1253 - protein, 14 aa, Homo sapiens
  TRBV20-1(TRBV) and TRBJ2-5(TRBJ)  CDR3 amino acids
CSARTAGLGTQYFG

SEQ ID NO: 1254 - protein, 14 aa, Homo sapiens
  TRBV27(TRBV) and TRBJ1-2(TRBJ)  CDR3 amino acids
CASRPTALGGYTFG

SEQ ID NO: 1255 - protein, 15 aa, Homo sapiens
  TRBV5-7(TRBV) and TRBJ1-5(TRBJ)  CDR3 amino acids
CAPRNHQIAISPSIL

SEQ ID NO: 1256 - protein, 17 aa, Homo sapiens
  TRBV7-9(TRBV) and TRBJ2-1(TRBJ)  CDR3 amino acids
CASSLGGRASYNEQFFG

SEQ ID NO: 1257 - protein, 17 aa, Homo sapiens
  TRBV11-1(TRBV) and TRBJ2-1(TRBJ)  CDR3 amino acids
CASSLMLAPLYNEQFFG

SEQ ID NO: 1258 - protein, 19 aa, Homo sapiens
  TRBV15(TRBV) and TRBJ2-3(TRBJ)  CDR3 amino acids
CATSRDTLAGGPEDTQYFG

SEQ ID NO: 1259 - protein, 16 aa, Homo sapiens
  TRBV11-1(TRBV) and TRBJ2-5(TRBJ)  CDR3 amino acids
CASSRDRGRQETQYFG

SEQ ID NO: 1260 - protein, 15 aa, Homo sapiens
  TRBV20-1(TRBV) and TRBJ2-1(TRBJ)  CDR3 amino acids
CSAPPGLAINEQFFG

SEQ ID NO: 1261 - protein, 16 aa, Homo sapiens
  TRBV20-1(TRBV) and TRBJ2-1(TRBJ)  CDR3 amino acids
CSARGWAGPYNEQFFG

SEQ ID NO: 1262 - protein, 14 aa, Homo sapiens
  TRBV12-4(TRBV) and TRBJ2-5(TRBJ)  CDR3 amino acids
CASSFGTPKRPSTS

SEQ ID NO: 1263 - protein, 15 aa, Homo sapiens
  TRBV11-2(TRBV) and TRBJ2-1(TRBJ)  CDR3 amino acids
CASSLVGLYNEQFFG

SEQ ID NO: 1264 - protein, 15 aa, Homo sapiens
  TRBV20-1(TRBV) and TRBJ2-3(TRBJ)  CDR3 amino acids
CSATGDSKINTQYFG

SEQ ID NO: 1265 - protein, 16 aa, Homo sapiens
  TRBV5-6(TRBV) and TRBJ2-1(TRBJ)  CDR3 amino acids
CASRSLWSSYNEQFFG

SEQ ID NO: 1266 - protein, 15 aa, Homo sapiens
  TRBV5-6(TRBV) and TRBJ1-1(TRBJ)  CDR3 amino acids
CASNPTEENTEAFFG

SEQ ID NO: 1267 - protein, 15 aa, Homo sapiens
  TRBV12-4(TRBV) and TRBJ2-5(TRBJ)  CDR3 amino acids
CASSFGTPQETQYFG

SEQ ID NO: 1268 - protein, 16 aa, Homo sapiens
  TRBV7-9(TRBV) and TRBJ2-1(TRBJ)  CDR3 amino acids
CASSQSRRAHNEQFFG

SEQ ID NO: 1269 - protein, 17 aa, Homo sapiens
  TRBV15(TRBV) and TRBJ2-1(TRBJ)  CDR3 amino acids
CATSREGLAGENEQFFG

SEQ ID NO: 1270 - protein, 17 aa, Homo sapiens
  TRBV12-5(TRBV) and TRBJ1-4(TRBJ)  CDR3 amino acids
CASGLESLGHLNENCFW

SEQ ID NO: 1271 - protein, 16 aa, Homo sapiens
  TRBV19(TRBV) and TRBJ1-5(TRBJ)  CDR3 amino acids
CASSIRDRSNQPQHFG

SEQ ID NO: 1272 - protein, 16 aa, Homo sapiens
  TRBV20-1(TRBV) and TRBJ1-3(TRBJ)  CDR3 amino acids
CSARRFGDGGDTIYFG

SEQ ID NO: 1273 - protein, 14 aa, Homo sapiens
  TRBV5-6(TRBV) and TRBJ2-2(TRBJ)  CDR3 amino acids
CASSLSVGGELFFG

SEQ ID NO: 1274 - protein, 15 aa, Homo sapiens
  TRBV6-3(TRBV) and TRBJ2-3(TRBJ)  CDR3 amino acids
CASSLAGVADTQYFG

SEQ ID NO: 1275 - protein, 15 aa, Homo sapiens
  TRBV7-9(TRBV) and TRBJ2-2(TRBJ)  CDR3 amino acids
CASSPGQYTGELFFG

SEQ ID NO: 1276 - protein, 17 aa, Homo sapiens
  TRBV11-3(TRBV) and TRBJ2-5(TRBJ)  CDR3 amino acids
CASSSTPTSGSRRPSTS

SEQ ID NO: 1277 - protein, 14 aa, Homo sapiens
  TRBV19(TRBV) and TRBJ1-1(TRBJ)  CDR3 amino acids
CASSQRRATEAFFG

SEQ ID NO: 1278 - protein, 16 aa, Homo sapiens
  TRBV27(TRBV) and TRBJ2-7(TRBJ)  CDR3 amino acids
CASTPQVGGINEQYFG

SEQ ID NO: 1279 - protein, 13 aa, Homo sapiens
  TRBV6-1(TRBV) and TRBJ2-3(TRBJ)  CDR3 amino acids
CASHRAPDTQYFG

SEQ ID NO: 1280 - protein, 16 aa, Homo sapiens
  TRBV6-1(TRBV) and TRBJ2-7(TRBJ)  CDR3 amino acids
CASTGRRQLTYEQYFG

SEQ ID NO: 1281 - protein, 14 aa, Homo sapiens
  TRBV10-3(TRBV) and TRBJ2-5(TRBJ)  CDR3 amino acids
CAISPGQEETQYFG

SEQ ID NO: 1282 - protein, 14 aa, Homo sapiens
  TRBV11-2(TRBV) and TRBJ1-2(TRBJ)  CDR3 amino acids
CASSLGRYYGYTFG

SEQ ID NO: 1283 - protein, 12 aa, Homo sapiens
  TRBV30(TRBV) and TRBJ2-2(TRBJ)  CDR3 amino acids
CAWSSGGELFLE

SEQ ID NO: 1284 - protein, 14 aa, Homo sapiens
  TRBV5-4(TRBV) and TRBJ1-1(TRBJ)  CDR3 amino acids
CASSLGQAKEAFFG

SEQ ID NO: 1285 - protein, 16 aa, Homo sapiens
  TRBV10-1(TRBV) and TRBJ2-1(TRBJ)  CDR3 amino acids
AASSEQLSSYNEQFFG

SEQ ID NO: 1286 - protein, 16 aa, Homo sapiens
  TRBV10-1(TRBV) and TRBJ2-1(TRBJ)  CDR3 amino acids
CASSEQLSSYNEQFFR

SEQ ID NO: 1287 - protein, 15 aa, Homo sapiens
  TRBV10-1(TRBV) and TRBJ2-1(TRBJ)  CDR3 amino acids
CASSTGQDRVMSSSS

SEQ ID NO: 1288 - protein, 16 aa, Homo sapiens
  TRBV10-1(TRBV) and TRBJ2-1(TRBJ)  CDR3 amino acids
CASSTRGQDRVMSSSS

SEQ ID NO: 1289 - protein, 20 aa, Homo sapiens
  TRBV10-2(TRBV) and TRBJ1-5(TRBJ)  CDR3 amino acids
CAQILGGDRGAGGKSAPSIF

SEQ ID NO: 1290 - protein, 19 aa, Homo sapiens
  TRBV10-2(TRBV) and TRBJ1-5(TRBJ)  CDR3 amino acids
CAQILGGDRGLGESAPAFW

SEQ ID NO: 1291 - protein, 19 aa, Homo sapiens
  TRBV10-2(TRBV) and TRBJ1-5(TRBJ)  CDR3 amino acids
CAQILGGDRGLGGISPSIL

SEQ ID NO: 1292 - protein, 18 aa, Homo sapiens
  TRBV10-2(TRBV) and TRBJ1-5(TRBJ)  CDR3 amino acids
CARFSEGQGAGGISPSIL

SEQ ID NO: 1293 - protein, 18 aa, Homo sapiens
  TRBV10-2(TRBV) and TRBJ1-5(TRBJ)  CDR3 amino acids
CARFSEGRGAGGISPSIL

SEQ ID NO: 1294 - protein, 19 aa, Homo sapiens
  TRBV10-2(TRBV) and TRBJ1-5(TRBJ)  CDR3 amino acids
CARFSEGRGGWGNQPQHFG

SEQ ID NO: 1295 - protein, 19 aa, Homo sapiens
  TRBV10-2(TRBV) and TRBJ1-5(TRBJ)  CDR3 amino acids
CARFSEGTGGSGESAPAFW

SEQ ID NO: 1296 - protein, 19 aa, Homo sapiens
  TRBV10-2(TRBV) and TRBJ1-5(TRBJ)  CDR3 amino acids
  misc_feature (19)..(19): Xaa can be any naturally occurring amino acid
CARFSEGTGGWGDQPQHFX

SEQ ID NO: 1297 - protein, 19 aa, Homo sapiens
  TRBV10-2(TRBV) and TRBJ1-5(TRBJ)  CDR3 amino acids
CARFSEGTGGWGESAPSIF

SEQ ID NO: 1298 - protein, 19 aa, Homo sapiens
  TRBV10-2(TRBV) and TRBJ1-5(TRBJ)  CDR3 amino acids
CARFSEGTGGWGNQPPAFL

SEQ ID NO: 1299 - protein, 18 aa, Homo sapiens
  TRBV10-2(TRBV) and TRBJ1-5(TRBJ)  CDR3 amino acids
CASFSEGQGLGESAPAFW

SEQ ID NO: 1300 - protein, 19 aa, Homo sapiens
  TRBV10-2(TRBV) and TRBJ1-5(TRBJ)  CDR3 amino acids
RARFSEGTGGWGNQPQHFG

SEQ ID NO: 1301 - protein, 20 aa, Homo sapiens
  TRBV10-2(TRBV) and TRBJ1-5(TRBJ)  CDR3 amino acids
  misc_feature (1)..(1): Xaa can be any naturally occurring amino acid
XAQILGGDRGAGGNQPQHFG

SEQ ID NO: 1302 - protein, 19 aa, Homo sapiens
  TRBV10-2(TRBV) and TRBJ1-5(TRBJ)  CDR3 amino acids
  misc_feature (1)..(1): Xaa can be any naturally occurring amino acid
XARFSEGTGGLGGISPSIL

SEQ ID NO: 1303 - protein, 16 aa, Homo sapiens
  TRBV10-3(TRBV) and TRBJ1-3(TRBJ)  CDR3 amino acids
CAISPNRGGLETPYIL

SEQ ID NO: 1304 - protein, 17 aa, Homo sapiens
  TRBV10-3(TRBV) and TRBJ1-3(TRBJ)  CDR3 amino acids
CAISPNRGGSGNTIYFG

SEQ ID NO: 1305 - protein, 15 aa, Homo sapiens
  TRBV10-3(TRBV) and TRBJ2-3(TRBJ)  CDR3 amino acids
CAIRPSGPHRYAVFL

SEQ ID NO: 1306 - protein, 15 aa, Homo sapiens
  TRBV10-3(TRBV) and TRBJ2-3(TRBJ)  CDR3 amino acids
  misc_feature (13)..(13): Xaa can be any naturally occurring amino acid
CAIRPSGPTDTQXLA

SEQ ID NO: 1307 - protein, 14 aa, Homo sapiens
  TRBV10-3(TRBV) and TRBJ2-3(TRBJ)  CDR3 amino acids
CAISIEAVQIRSIL

SEQ ID NO: 1308 - protein, 15 aa, Homo sapiens
  TRBV10-3(TRBV) and TRBJ2-3(TRBJ)  CDR3 amino acids
  misc_feature (8)..(8): Xaa can be any naturally occurring amino acid
  misc_feature (10)..(10): Xaa can be any naturally occurring amino acid
CAISIEAXTXTQYFA

SEQ ID NO: 1309 - protein, 13 aa, Homo sapiens
  TRBV10-3(TRBV) and TRBJ2-3(TRBJ)  CDR3 amino acids
CAISSTTDTQYFW

SEQ ID NO: 1310 - protein, 16 aa, Homo sapiens
  TRBV10-3(TRBV) and TRBJ2-5(TRBJ)  CDR3 amino acids
CAISEPTGIRRDPVLR

SEQ ID NO: 1311 - protein, 16 aa, Homo sapiens
  TRBV10-3(TRBV) and TRBJ2-7(TRBJ)  CDR3 amino acids
CAISESASGSYEQYFG

SEQ ID NO: 1312 - protein, 12 aa, Homo sapiens
  TRBV11-1(TRBV) and TRBJ2-1(TRBJ)  CDR3 amino acids
CASRLYTEQFFG

SEQ ID NO: 1313 - protein, 13 aa, Homo sapiens
  TRBV11-1(TRBV) and TRBJ2-1(TRBJ)  CDR3 amino acids
CASSFGGLLSSSS

SEQ ID NO: 1314 - protein, 14 aa, Homo sapiens
  TRBV11-1(TRBV) and TRBJ2-1(TRBJ)  CDR3 amino acids
CASSFPGGLLSSSS

SEQ ID NO: 1315 - protein, 11 aa, Homo sapiens
  TRBV11-1(TRBV) and TRBJ2-1(TRBJ)  CDR3 amino acids
CASSFTMSSSS

SEQ ID NO: 1316 - protein, 12 aa, Homo sapiens
  TRBV11-1(TRBV) and TRBJ2-1(TRBJ)  CDR3 amino acids
CASSVFTMSSSS

SEQ ID NO: 1317 - protein, 12 aa, Homo sapiens
  TRBV11-1(TRBV) and TRBJ2-1(TRBJ)  CDR3 amino acids
  misc_feature (3)..(3): Xaa can be any naturally occurring amino acid
CAXSFYNEQFFG

SEQ ID NO: 1318 - protein, 12 aa, Homo sapiens
  TRBV11-1(TRBV) and TRBJ2-1(TRBJ)  CDR3 amino acids
VPSSFYNEQFFR

SEQ ID NO: 1319 - protein, 14 aa, Homo sapiens
  TRBV11-1(TRBV) and TRBJ2-3(TRBJ)  CDR3 amino acids
CASSFRSCRYAVFW

SEQ ID NO: 1320 - protein, 14 aa, Homo sapiens
  TRBV11-1(TRBV) and TRBJ2-3(TRBJ)  CDR3 amino acids
CASSLDRADTQYFG

SEQ ID NO: 1321 - protein, 13 aa, Homo sapiens
  TRBV11-1(TRBV) and TRBJ2-3(TRBJ)  CDR3 amino acids
CASTLRFRIRSIL

SEQ ID NO: 1322 - protein, 15 aa, Homo sapiens
  TRBV11-1(TRBV) and TRBJ2-5(TRBJ)  CDR3 amino acids
CASSFRPGTETPVLR

SEQ ID NO: 1323 - protein, 11 aa, Homo sapiens
  TRBV11-1(TRBV) and TRBJ2-5(TRBJ)  CDR3 amino acids
CASSSETQYFG

SEQ ID NO: 1324 - protein, 15 aa, Homo sapiens
  TRBV11-1(TRBV) and TRBJ1-1(TRBJ)  CDR3 amino acids
CASSLQGANTEAFFG

SEQ ID NO: 1325 - DNA, 10 bp, artificial sequence
  Tag sequence
acgagtgcgt

SEQ ID NO: 1326 - DNA, 10 bp, artificial sequence
  Tag sequence
acgctcgaca

SEQ ID NO: 1327 - DNA, 10 bp, artificial sequence
  Tag sequence
agacgcactc

SEQ ID NO: 1328 - DNA, 10 bp, artificial sequence
  Tag sequence
agcactgtag

SEQ ID NO: 1329 - DNA, 10 bp, artificial sequence
  Tag sequence
atcagacacg

SEQ ID NO: 1330 - DNA, 10 bp, artificial sequence
  Tag sequence
atatcgcgag

SEQ ID NO: 1331 - DNA, 10 bp, artificial sequence
  Tag sequence
cgtgtctcta

SEQ ID NO: 1332 - DNA, 10 bp, artificial sequence
  Tag sequence
ctcgcgtgtc

SEQ ID NO: 1333 - DNA, 10 bp, artificial sequence
  Tag sequence
tagtatcagc

SEQ ID NO: 1334 - DNA, 10 bp, artificial sequence
  Tag sequence
tctctatgcg

SEQ ID NO: 1335 - DNA, 10 bp, artificial sequence
  Tag sequence
tgatacgtct

SEQ ID NO: 1336 - DNA, 10 bp, artificial sequence
  IGHD  CDR3 amino acids
tactgagcta

SEQ ID NO: 1337 - DNA, 10 bp, artificial sequence
  Tag sequence
catagtagtg

SEQ ID NO: 1338 - DNA, 10 bp, artificial sequence
  Tag sequence
cgagagatac

SEQ ID NO: 1339 - DNA, 10 bp, artificial sequence
  Tag sequence
atacgacgta

SEQ ID NO: 1340 - DNA, 10 bp, artificial sequence
  Tag sequence
tcacgtacta

SEQ ID NO: 1341 - DNA, 10 bp, artificial sequence
  Tag sequence
cgtctagtac

SEQ ID NO: 1342 - DNA, 10 bp, artificial sequence
  Tag sequence
tctacgtagc

SEQ ID NO: 1343 - DNA, 10 bp, artificial sequence
  Tag sequence
tgtactactc

SEQ ID NO: 1344 - DNA, 10 bp, artificial sequence
  Tag sequence
acgactacag

SEQ ID NO: 1345 - DNA, 10 bp, artificial sequence
  Tag sequence
cgtagactag

SEQ ID NO: 1346 - DNA, 10 bp, artificial sequence
  Tag sequence
tacgagtatg

SEQ ID NO: 1347 - DNA, 10 bp, artificial sequence
  Tag sequence
tactctcgtg

SEQ ID NO: 1348 - DNA, 10 bp, artificial sequence
  Tag sequence
tagagacgag

SEQ ID NO: 1349 - DNA, 10 bp, artificial sequence
  Tag sequence
tcgtcgctcg

SEQ ID NO: 1350 - DNA, 10 bp, artificial sequence
  Tag sequence
acatacgcgt

SEQ ID NO: 1351 - DNA, 11 bp, artificial sequence
  Tag sequence
acacgacgact

SEQ ID NO: 1352 - DNA, 11 bp, artificial sequence
  Tag sequence
acacgtagtat

SEQ ID NO: 1353 - DNA, 11 bp, artificial sequence
  Tag sequence
acactactcgt

SEQ ID NO: 1354 - DNA, 11 bp, artificial sequence
  Tag sequence
acgacacgtat

SEQ ID NO: 1355 - DNA, 11 bp, artificial sequence
  Tag sequence
acgagtagact

SEQ ID NO: 1356 - DNA, 11 bp, artificial sequence
  Tag sequence
acgcgtctagt

SEQ ID NO: 1357 - DNA, 11 bp, artificial sequence
  Tag sequence
acgtacacact

SEQ ID NO: 1358 - DNA, 11 bp, artificial sequence
  Tag sequence
acgtactgtgt

SEQ ID NO: 1359 - DNA, 11 bp, artificial sequence
  IGHD  CDR3 amino acids
acgtagatcgt

SEQ ID NO: 1360 - DNA, 11 bp, artificial sequence
  Tag sequence
actacgtctct

SEQ ID NO: 1361 - DNA, 11 bp, artificial sequence
  Tag sequence
actatacgagt

SEQ ID NO: 1362 - DNA, 11 bp, artificial sequence
  Tag sequence
actcgcgtcgt

SEQ ID NO: 1363 - DNA, 11 bp, artificial sequence
  Tag sequence
agtcgtggtgt

SEQ ID NO: 1364 - DNA, 11 bp, artificial sequence
  Tag sequence
atactaggtgt

SEQ ID NO: 1365 - DNA, 11 bp, artificial sequence
  Tag sequence
acgagtggtgt

SEQ ID NO: 1366 - DNA, 11 bp, artificial sequence
  Tag sequence
atacgtggcgt

SEQ ID NO: 1367 - DNA, 11 bp, artificial sequence
  Tag sequence
agtctacgcgt

SEQ ID NO: 1368 - DNA, 11 bp, artificial sequence
  Tag sequence
actagaggcgt

SEQ ID NO: 1369 - DNA, 11 bp, artificial sequence
  Tag sequence
agtgtgtgcgt

SEQ ID NO: 1370 - DNA, 11 bp, artificial sequence
  Tag sequence
acacagtgcgt

SEQ ID NO: 1371 - DNA, 11 bp, artificial sequence
  Tag sequence
acgatctgcgt

SEQ ID NO: 1372 - DNA, 11 bp, artificial sequence
  Tag sequence
agagacggagt

SEQ ID NO: 1373 - DNA, 11 bp, artificial sequence
  Tag sequence
actcgtagagt

SEQ ID NO: 1374 - DNA, 11 bp, artificial sequence
  Tag sequence
acgacgggagt

SEQ ID NO: 1375 - DNA, 26 bp, artificial sequence
  B adaptor
cctatcccctgtgtgccttggcagtc

SEQ ID NO: 1376 - DNA, 423 bp, artificial sequence
  TRAC*01  primer
  misc_feature (1)..(1): n is a, c, g, t or u
natatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagc

SEQ ID NO: 1377 - DNA, 537 bp, artificial sequence
  TRBC2  primer
gaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 1378 - DNA, 519 bp, artificial sequence
  TRGC1*01  primer
gataaacaacttgatgcagatgtttcccccaagcccactatttttcttccttcaattgctgaaacaaagctccagaaggctggaacatacctttgtcttcttgagaaatttttccctgatgttattaagatacattggcaagaaaagaagagcaacacgattctgggatcccaggaggggaacaccatgaagactaacgacacatacatgaaatttagctggttaacggtgccagaaaagtcactggacaaagaacacagatgtatcgtcagacatgagaataataaaaacggagttgatcaagaaattatctttcctccaataaagacagatgtcatcacaatggatcccaaagacaattgttcaaaagatgcaaatgatacactactgctgcagctcacaaacacctctgcatattacatgtacctcctcctgctcctcaagagtgtggtctattttgccatcatcacctgctgtctgcttagaagaacggctttctgctgcaatggagagaaatca

SEQ ID NO: 1379 - DNA, 466 bp, artificial sequence
  TRDC*01  primer
  misc_feature (1)..(1): n is a, c, g, t or u
ngaagtcagcctcataccaaaccatccgtttttgtcatgaaaaatggaacaaatgtcgcttgtctggtgaaggaattctaccccaaggatataagaataaatctcgtgtcatccaagaagataacagagtttgatcctgctattgtcatctctcccagtgggaagtacaatgctgtcaagcttggtaaatatgaagattcaaattcagtgacatgttcagttcaacacgacaataaaactgtgcactccactgactttgaagtgaagacagattctacagatcacgtaaaaccaaaggaaactgaaaacacaaagcaaccttcaaagagctgccataaacccaaagccatagttcataccgagaaggtgaacatgatgtccctcacagtgcttgggctacgaatgctgtttgcaaagactgttgccgtcaattttctcttgactgccaagttatttttcttgtaag

SEQ ID NO: 1380 - DNA, 1419 bp, artificial sequence
  IGHM*01  primer
gggagtgcatccgccccaacccttttccccctcgtctcctgtgagaattccccgtcggatacgagcagcgtggccgttggctgcctcgcacaggacttccttcccgactccatcactttgtcctggaaatacaagaacaactctgacatcagcagtacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttccagtgattgccgagctgcctcccaaagtgagcgtcttcgtcccaccccgcgacggcttcttcggcaacccccgcaagtccaagctcatctgccaggccacgggtttcagtccccggcagattcaggtgtcctggctgcgcgaggggaagcaggtggggtctggcgtcaccacggaccaggtgcaggctgaggccaaagagtctgggcccacgacctacaaggtgaccagcacactgaccatcaaagagagcgactggctcggccagagcatgttcacctgccgcgtggatcacaggggcctgaccttccagcagaatgcgtcctccatgtgtgtccccgatcaagacacagccatccgggtcttcgccatccccccatcctttgccagcatcttcctcaccaagtccaccaagttgacctgcctggtcacagacctgaccacctatgacagcgtgaccatctcctggacccgccagaatggcgaagctgtgaaaacccacaccaacatctccgagagccaccccaatgccactttcagcgccgtgggtgaggccagcatctgcgaggatgactggaattccggggagaggttcacgtgcaccgtgacccacacagacctgccctcgccactgaagcagaccatctcccggcccaagggggtggccctgcacaggcccgatgtctacttgctgccaccagcccgggagcagctgaacctgcgggagtcggccaccatcacgtgcctggtgacgggcttctctcccgcggacgtcttcgtgcagtggatgcagagggggcagcccttgtccccggagaagtatgtgaccagcgccccaatgcctgagccccaggccccaggccggtacttcgcccacagcatcctgaccgtgtccgaagaggaatggaacacgggggagacctacacctgcgtggcccatgaggccctgcccaacagggtcaccgagaggaccgtggacaagtccaccgagggggaggtgagcgccgacgaggagggctttgagaacctgtgggccaccgcctccaccttcatcgtcctcttcctcctgagcctcttctacagtaccaccgtcaccttgttcaaggtgaaa

SEQ ID NO: 1381 - DNA, 1059 bp, artificial sequence
  IGHA1*01  primer
gcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctac

SEQ ID NO: 1382 - DNA, 990 bp, artificial sequence
  IGHG1*01  primer
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1383 - DNA, 1290 bp, artificial sequence
  IGHD*01  primer
gcacccaccaaggctccggatgtgttccccatcatatcagggtgcagacacccaaaggataacagccctgtggtcctggcatgcttgataactgggtaccacccaacgtccgtgactgtcacctggtacatggggacacagagccagccccagagaaccttccctgagatacaaagacgggacagctactacatgacaagcagccagctctccacccccctccagcagtggcgccaaggcgagtacaaatgcgtggtccagcacaccgccagcaagagtaagaaggagatcttccgctggccagagtctccaaaggcacaggcctcctccgtgcccactgcacaaccccaagcagagggcagcctcgccaaggcaaccacagccccagccaccacccgtaacacaggaagaggaggagaagagaagaagaaggagaaggagaaagaggaacaagaagagagagagacaaagacaccagagtgtccgagccacacccagcctcttggcgtctacctgctaacccctgcagtgcaggacctgtggctccgggacaaagccaccttcacctgcttcgtggtgggcagtgacctgaaggatgctcacctgacctgggaggtggctgggaaggtccccacagggggcgtggaggaagggctgctggagcggcacagcaacggctcccagagccagcacagccgtctgaccctgcccaggtccttgtggaacgcggggacctccgtcacctgcacactgaaccatcccagcctcccaccccagaggttgatggcgctgagagaacccgctgcgcaggcacccgtcaagctttctctgaacctgctggcctcgtctgaccctcccgaggcggcctcgtggctcctgtgtgaggtgtctggcttctcgccccccaacatcctcctgatgtggctggaggaccagcgtgaggtgaacacttctgggtttgcccccgcacgcccccctccacagcccaggagcaccacgttctgggcctggagtgtgctgcgtgtcccagccccgcccagccctcagccagccacctacacgtgtgtggtcagccacgaggactcccggactctgctcaacgccagccggagcctagaagtcagctacctggccatgacccccctgatccctcagagcaaggatgagaacagcgatgactacacgacctttgatgatgtgggcagcctgtggaccaccctgtccacgtttgtggccctcttcatcctcaccctcctctacagcggcattgtcactttcatcaaggtgaag

SEQ ID NO: 1384 - DNA, 1284 bp, artificial sequence
  IGHE*01  primer
gcctccacacagagcccatccgtcttccccttgacccgctgctgcaaaaacattccctccaatgccacctccgtgactctgggctgcctggccacgggctacttcccggagccggtgatggtgacctgcgacacaggctccctcaacgggacaactatgaccttaccagccaccaccctcacgctctctggtcactatgccaccatcagcttgctgaccgtctcgggtgcgtgggccaagcagatgttcacctgccgtgtggcacacactccatcgtccacagactgggtcgacaacaaaaccttcagcgtctgctccagggacttcaccccgcccaccgtgaagatcttacagtcgtcctgcgacggcggcgggcacttccccccgaccatccagctcctgtgcctcgtctctgggtacaccccagggactatcaacatcacctggctggaggacgggcaggtcatggacgtggacttgtccaccgcctctaccacgcaggagggtgagctggcctccacacaaagcgagctcaccctcagccagaagcactggctgtcagaccgcacctacacctgccaggtcacctatcaaggtcacacctttgaggacagcaccaagaagtgtgcagattccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccggtaaa

SEQ ID NO: 1385 - DNA, 321 bp, artificial sequence
  IGKC*01  primer
cgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1386 - DNA, 312 bp, artificial sequence
  IGLC1*01  primer
cccaaggccaaccccacggtcactctgttcccgccctcctctgaggagctccaagccaacaaggccacactagtgtgtctgatcagtgacttctacccgggagctgtgacagtggcttggaaggcagatggcagccccgtcaaggcgggagtggagacgaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 1387 - DNA, 19 bp, artificial sequence
  Specific sequence in CM3-GS (CM3)
aaagggttggggcggatgc

SEQ ID NO: 1388 - DNA, 20 bp, artificial sequence
  Specific sequence in CA3-GS (CA3)
ccgctttcgctccaggtcac

SEQ ID NO: 1389 - DNA, 21 bp, artificial sequence
  Specific sequence in CG3-GS (CG3)
tgagttccacgacaccgtcac

SEQ ID NO: 1390 - DNA, 19 bp, artificial sequence
  Specific sequence in CD3-GS (CD3)
cccagttatcaagcatgcc

SEQ ID NO: 1391 - DNA, 20 bp, artificial sequence
  Specific sequence in CE3-GS (CE3)
cattggagggaatgtttttg

SEQ ID NO: 1392 - DNA, 537 bp, artificial sequence; identical to SEQ ID NO: 1377
  TRBC2*01

SEQ ID NO: 1393 - DNA, 537 bp, artificial sequence
  TRBC2*02
gaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 1394 - DNA, 301 bp, artificial sequence
  TRGC1*02
gataaacaacttgatgcagatgtttcccccaagcccactatttttcttccttcgattgctgaaacaaaactccagaaggctggaacatacctttgtcttcttgagaaatttttcccagatattattaagatacattggcaagaaaagaagagcaacacgattctgggatcccaggaggggaacaccatgaagactaacgacacatacatgaaatttagctggttaacggtgccagaagagtcactggacaaagaacacagatgtatcgtcagacatgagaataataaaaacggaattgatc

SEQ ID NO: 1395 - DNA, 568 bp, artificial sequence
  TRGC2*01
gataaacaacttgatgcagatgtttcccccaagcccactatttttcttccttcaattgctgaaacaaaactccagaaggctggaacatacctttgtcttcttgagaaatttttcccagatattattaagatacattggcaagaaaagaagagcaacacgattctgggatcccaggaggggaacaccatgaagactaacgacacatacatgaaatttagctggttaacggtgccagaagagtcactggacaaagaacacagatgtatcgtcagacatgagaataataaaaacggaattgatcaagaaattatctttcctccaataaagacaggatgtcaccacagtggatcccaaagacagttattcaaaagatgcaaatgatgtcatcacaatggatcccaaagacaattggtcaaaagatgcaaatgatacactactgctgcagctcacaaacacctctgcatattacatgtacctcctcctgctcctcaagagtgtggtctattttgccatcatcacctgctgtctgcttggaagaacggctttctgctgcaatggagagaaatca

SEQ ID NO: 1396 - DNA, 567 bp, artificial sequence
  TRGC2*02
gataaacaacttgatgcagatgtttcccccaagcccactatttttcttccttcgattgctgaaacaaaactccagaaggctggaacatacctttgtcttcttgagaaatttttcccagatattattaagatacattggcaagaaaagaagagcaacacgattctgggatcccaggaggggaacaccatgaagactaacgacacatacatgaaatttagctggttaacggtgccagaagagtcactggacaaagaacacagatgtatcgtcagacatgagaataataaaaacggaattgatcaagaaattatctttcctccaataaagacagatgtcaccacagtggatcccaaatacaattattcaaaggatgcaaatgatgtcatcacaatggatcccaaagacaattggtcaaaagatgcaaatgatacactactgctgcagctcacaaacacctctgcatattacatgtacctcctcctgctcctcaagagtgtggtctattttgccatcatcacctgctgtctgcttggaagaacggctttctgctgcaatggagagaaatca

SEQ ID NO: 1397 - DNA, 567 bp, artificial sequence
  TRGC2*03
gataaacaacttgatgcagatgtttcccccaagcccactatttttcttccttcgattgctgaaacaaaactccagaaggctggaacatacctttgtcttcttgagaaatttttcccagatattattaagatacattggcaagaaaagaagagcaacacgattctgggatcccaggaggggaacaccatgaagactaacgacacatacatgaaatttagctggttaacggtgccagaagagtcactggacaaagaacacagatgtatcgtcagacatgagaataataaaaacggaattgatcaagaaattatctttcctccaataaagacagatgtcaccacagtggatcccaaatacaattattcaaaggatgcaaatgatgtcatcacaatggatcccaaagacaattggtcaaaagatgcaattgatacactactgctgcagctcacaaacacctctgcatattacatgtacctcctcctgctcctcaagagtggtgtctattttgccatcatcacctgctgtctgcttagaagaacggctttctgctgcaatggagagaaatca

SEQ ID NO: 1398 - DNA, 567 bp, artificial sequence
  TRGC2*04
gataaacaacttgatgcagatgtttcccccaagcccactatttttcttccttcaattgctgaaacaaaactccagaaggctggaacatacctttgtcttcttgagaaatttttcccagatattattaagatacattggcaagaaaagaagagcaacacgattctgggatcccaggaggggaacaccatgaagactaacgacacatacatgaaatttagctggttaacggtgccagaagagtcactggacaaagaacacagatgtatcgtcagacatgagaataataaaaacggaattgatcaagaaattatctttcctccaataaagacagatgtcaccacagtggatcccaaatacaattattcaaaggatgcaaatgatgtcatcacaatggatcccaaagacaattggtcaaaagatgcaattgatacactactgctgcagctcacaaacacctctgcatattacatgtacctcctcctgctcctcaagagtgtggtctattttgccatcatcacctgctgtctgcttggaagaacggctttctgctgcaatggagagaaatca

SEQ ID NO: 1399 - DNA, 615 bp, artificial sequence
  TRGC2*05
gataaacaacttgatgcagatgtttcccccaagcccactatttttcttccttcgattgctgaaacaaaactccagaaggctggaacatatctttgtcttcttgagaaatttttcccagatattattaagatacattggcaagaaaagaagagcaacacgattctgggatcccaggaggggaacaccatgaagactaacgacacatacatgaaatttagctggttaacggtgccagaagagtcactggacaaagaacacagatgtatcgtcagacatgagaataataaaaacggaattgatcaagaaattatctttcctccaataaagacagatgtcaccacagtggatcccaaagacagttattcaaaagatgcaaatgatgtcaccacagtggatcccaaatacaattattcaaaggatgcaaatgatgtcatcacaatggatcccaaagacaattggtcaaaagatgcaaatgatacactactgctgcagctcacaaacacctctgcatattacatgtacctcctcctgctcctcaagagtgtggtctattttgccatcatcacctgctgtctgcttggaagaacggctttctgctgcaatggagagaaatca

SEQ ID NO: 1400 - DNA, 1020 bp, artificial sequence
  IGHA2*01
gcatccccgaccagccccaaggtcttcccgctgagcctcgacagcaccccccaagatgggaacgtggtcgtcgcatgcctggtccagggcttcttcccccaggagccactcagtgtgacctggagcgaaagcggacagaacgtgaccgccagaaacttcccacctagccaggatgcctccggggacctgtacaccacgagcagccagctgaccctgccggccacacagtgcccagacggcaagtccgtgacatgccacgtgaagcactacacgaatcccagccaggatgtgactgtgccctgcccagttcccccacctcccccatgctgccacccccgactgtcgctgcaccgaccggccctcgaggacctgctcttaggttcagaagcgaacctcacgtgcacactgaccggcctgagagatgcctctggtgccaccttcacctggacgccctcaagtgggaagagcgctgttcaaggaccacctgagcgtgacctctgtggctgctacagcgtgtccagtgtcctgcctggctgtgcccagccatggaaccatggggagaccttcacctgcactgctgcccaccccgagttgaagaccccactaaccgccaacatcacaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctac

SEQ ID NO: 1401 - DNA, 984 bp, artificial sequence
  IGHA2*02s
gcatccccgaccagccccaaggtcttcccgctgagcctcgacagcaccccccaagatgggaacgtggtcgtcgcatgcctggtccagggcttcttcccccaggagccactcagtgtgacctggagcgaaagcggacagaacgtgaccgccagaaacttcccacctagccaggatgcctccggggacctgtacaccacgagcagccagctgaccctgccggccacacagtgcccagacggcaagtccgtgacatgccacgtgaagcactacacgaattccagccaggatgtgactgtgccctgccgagttcccccacctcccccactcgaggacctgctcttaggttcagaagcgaacctcacgtgcacactgaccggcctgagagatgcctctggtgccaccttcacctggacgccctcaagtgggaagagcgctgttcaaggaccacctgagcgtgacctctgtggctgctacagcgtgtccagtgtcctgcctggctgtgcccagccatggaaccatggggagaccttcacctgcactgctgcccaccccgagttgaagaccccactaaccgccaacatcacaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccacctacgctgtaaccagcatactgcgcgtggcagctgaggactggaagaagggggagaccttctcctgcatggtgggccacgaggccctgccgctggccttcacacagaagaccatcgaccgcatggcgggtaaacccacccacatcaatgtgtctgttgtcatggcggaggcggatggcacctgctac

SEQ ID NO: 1402 - DNA, 1173 bp, artificial sequence
  IGHA2*02
gcatccccgaccagccccaaggtcttcccgctgagcctcgacagcaccccccaagatgggaacgtggtcgtcgcatgcctggtccagggcttcttcccccaggagccactcagtgtgacctggagcgaaagcggacagaacgtgaccgccagaaacttcccacctagccaggatgcctccggggacctgtacaccacgagcagccagctgaccctgccggccacacagtgcccagacggcaagtccgtgacatgccacgtgaagcactacacgaattccagccaggatgtgactgtgccctgccgagttcccccacctcccccatgctgccacccccgactgtcgctgcaccgaccggccctcgaggacctgctcttaggttcagaagcgaacctcacgtgcacactgaccggcctgagagatgcctctggtgccaccttcacctggacgccctcaagtgggaagagcgctgttcaaggaccacctgagcgtgacctctgtggctgctacagcgtgtccagtgtcctgcctggctgtgcccagccatggaaccatggggagaccttcacctgcactgctgcccaccccgagttgaagaccccactaaccgccaacatcacaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccacctacgctgtaaccagcatactgcgcgtggcagctgaggactggaagaagggggagaccttctcctgcatggtgggccacgaggccctgccgctggccttcacacagaagaccatcgaccgcatggcgggctcttgctgtgttgcagattggcagatgccgcctccctatgtggtgctggacttgccgcaggagaccctggaggaggagacccccggcgccaacctgtggcccaccaccatcaccttcctcaccctcttcctgctgagcctgttctatagcacagcactgaccgtgaccagcgtccggggcccatctggcaagagggagggcccccagtac

SEQ ID NO: 1403 - DNA, 1020 bp, artificial sequence
  IGHA2*03
gcatccccgaccagccccaaggtcttcccgctgagcctcgacagcaccccccaagatgggaacgtggtcgtcgcatgcctggtccagggcttcttcccccaggagccactcagtgtgacctggagcgaaagcggacagaacgtgaccgccagaaacttcccacctagccaggatgcctccggggacctgtacaccacgagcagccagctgaccctgccggccacacagtgcccagacggcaagtccgtgacatgccacgtgaagcactacacgaattccagccaggatgtgactgtgccctgccgagttcccccacctcccccatgctgccacccccgactgtcgctgcaccgaccggccctcgaggacctgctcttaggttcagaagcgaacctcacgtgcacactgaccggcctgagagatgcctctggtgccaccttcacctggacgccctcaagtgggaagagcgctgttcaaggaccacctgagcgtgacctctgtggctgctacagcgtgtccagtgtcctgcctggctgtgcccagccatggaaccatggggagaccttcacctgcactgctgcccaccccgagttgaagaccccactaaccgccaacatcacaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctac

SEQ ID NO: 1404 - DNA, 1152 bp, artificial sequence
  IGHD*01
gcacccaccaaggctccggatgtgttccccatcatatcagggtgcagacacccaaaggataacagccctgtggtcctggcatgcttgataactgggtaccacccaacgtccgtgactgtcacctggtacatggggacacagagccagccccagagaaccttccctgagatacaaagacgggacagctactacatgacaagcagccagctctccacccccctccagcagtggcgccaaggcgagtacaaatgcgtggtccagcacaccgccagcaagagtaagaaggagatcttccgctggccagagtctccaaaggcacaggcctcctccgtgcccactgcacaaccccaagcagagggcagcctcgccaaggcaaccacagccccagccaccacccgtaacacaggaagaggaggagaagagaagaagaaggagaaggagaaagaggaacaagaagagagagagacaaagacaccagagtgtccgagccacacccagcctcttggcgtctacctgctaacccctgcagtgcaggacctgtggctccgggacaaagccaccttcacctgcttcgtggtgggcagtgacctgaaggatgctcacctgacctgggaggtggctgggaaggtccccacagggggcgtggaggaagggctgctggagcggcacagcaacggctcccagagccagcacagccgtctgaccctgcccaggtccttgtggaacgcggggacctccgtcacctgcacactgaaccatcccagcctcccaccccagaggttgatggcgctgagagaacccgctgcgcaggcacccgtcaagctttctctgaacctgctggcctcgtctgaccctcccgaggcggcctcgtggctcctgtgtgaggtgtctggcttctcgccccccaacatcctcctgatgtggctggaggaccagcgtgaggtgaacacttctgggtttgcccccgcacgcccccctccacagcccaggagcaccacgttctgggcctggagtgtgctgcgtgtcccagccccgcccagccctcagccagccacctacacgtgtgtggtcagccacgaggactcccggactctgctcaacgccagccggagcctagaagtcagctatgtaacagaccatggccccatgaaa

SEQ ID NO: 1405 - DNA, 1152 bp, artificial sequence
  IGHD*02
gcacccaccaaggctccggatgtgttccccatcatatcagggtgcagacacccaaaggataacagccctgtggtcctggcatgcttgataactgggtaccacccaacgtccgtgactgtcacctggtacatggggacacagagccagccccagagaaccttccctgagatacaaagacgggacagctactacatgacaagcagccagctctccacccccctccagcagtggcgccaaggcgagtacaaatgcgtggtccagcacaccgccagcaagagtaagaaggagatcttccgctggccagagtctccaaaggcacaggcctcctcagtgcccactgcacaaccccaagcagagggcagcctcgccaaggcaaccacagccccagccaccacccgtaacacaggaagaggaggagaagagaagaagaaggagaaggagaaagaggaacaagaagagagagagacaaagacaccagagtgtccgagccacacccagcctcttggcgtctacctgctaacccctgcagtgcaggacctgtggctccgggacaaagccaccttcacctgcttcgtggtgggcagtgacctgaaggatgctcacctgacctgggaggtggctgggaaggtccccacagggggcgtggaggaagggctgctggagcggcacagcaacggctcccagagccagcacagccgtctgaccctgcccaggtccttgtggaacgcggggacctccgtcacctgcacactgaaccatcccagcctcccaccccagaggttgatggcgctgagagaacccgctgcgcaggcacccgtcaagctttccctgaacctgctggcctcgtctgaccctcccgaggcggcctcgtggctcctgtgtgaggtgtctggcttctcgccccccaacatcctcctgatgtggctggaggaccagcgtgaggtgaacacttctgggtttgcccccgcacgcccccctccacagcccaggagcaccacgttctgggcctggagtgtgctgcgtgtcccagccccgcccagccctcagccagccacctacacgtgtgtggtcagccacgaggactcccggactctgctcaacgccagccggagcctagaagtcagctatgtaacagaccatggccccatgaaa

SEQ ID NO: 1406 - DNA, 1290 bp, artificial sequence
  IGHD*02
gcacccaccaaggctccggatgtgttccccatcatatcagggtgcagacacccaaaggataacagccctgtggtcctggcatgcttgataactgggtaccacccaacgtccgtgactgtcacctggtacatggggacacagagccagccccagagaaccttccctgagatacaaagacgggacagctactacatgacaagcagccagctctccacccccctccagcagtggcgccaaggcgagtacaaatgcgtggtccagcacaccgccagcaagagtaagaaggagatcttccgctggccagagtctccaaaggcacaggcctcctcagtgcccactgcacaaccccaagcagagggcagcctcgccaaggcaaccacagccccagccaccacccgtaacacaggaagaggaggagaagagaagaagaaggagaaggagaaagaggaacaagaagagagagagacaaagacaccagagtgtccgagccacacccagcctcttggcgtctacctgctaacccctgcagtgcaggacctgtggctccgggacaaagccaccttcacctgcttcgtggtgggcagtgacctgaaggatgctcacctgacctgggaggtggctgggaaggtccccacagggggcgtggaggaagggctgctggagcggcacagcaacggctcccagagccagcacagccgtctgaccctgcccaggtccttgtggaacgcggggacctccgtcacctgcacactgaaccatcccagcctcccaccccagaggttgatggcgctgagagaacccgctgcgcaggcacccgtcaagctttccctgaacctgctggcctcgtctgaccctcccgaggcggcctcgtggctcctgtgtgaggtgtctggcttctcgccccccaacatcctcctgatgtggctggaggaccagcgtgaggtgaacacttctgggtttgcccccgcacgcccccctccacagcccaggagcaccacgttctgggcctggagtgtgctgcgtgtcccagccccgcccagccctcagccagccacctacacgtgtgtggtcagccacgaggactcccggactctgctcaacgccagccggagcctagaagtcagctacctggccatgacccccctgatccctcagagcaaggatgagaacagcgatgactacacgacctttgatgatgtgggcagcctgtggaccaccctgtccacgtttgtggccctcttcatcctcaccctcctctacagcggcattgtcactttcatcaaggtgaag

SEQ ID NO: 1407 - DNA, 1482 bp, artificial sequence
  IGHE*01
gcctccacacagagcccatccgtcttccccttgacccgctgctgcaaaaacattccctccaatgccacctccgtgactctgggctgcctggccacgggctacttcccggagccggtgatggtgacctgcgacacaggctccctcaacgggacaactatgaccttaccagccaccaccctcacgctctctggtcactatgccaccatcagcttgctgaccgtctcgggtgcgtgggccaagcagatgttcacctgccgtgtggcacacactccatcgtccacagactgggtcgacaacaaaaccttcagcgtctgctccagggacttcaccccgcccaccgtgaagatcttacagtcgtcctgcgacggcggcgggcacttccccccgaccatccagctcctgtgcctcgtctctgggtacaccccagggactatcaacatcacctggctggaggacgggcaggtcatggacgtggacttgtccaccgcctctaccacgcaggagggtgagctggcctccacacaaagcgagctcaccctcagccagaagcactggctgtcagaccgcacctacacctgccaggtcacctatcaaggtcacacctttgaggacagcaccaagaagtgtgcagattccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccgagctggacgtgtgcgtggaggaggccgagggcgaggcgccgtggacgtggaccggcctctgcatcttcgccgcactcttcctgctcagcgtgagctacagcgccgccctcacgctcctcatggtgcagcggttcctctcagccacgcggcaggggaggccccagacctccctcgactacaccaacgtcctccagccccacgcc

SEQ ID NO: 1408 - DNA, 1284 bp, artificial sequence
  IGHE*02
gcctccacacagagcccatccgtcttccccttgacccgctgctgcaaaaacattccctccaatgccacctccgtgactctgggctgcctggccacgggctacttcccggagccggtgatggtgacctgggacacaggctccctcaacgggacaactatgaccttaccagccaccaccctcacgctctctggtcactatgccaccatcagcttgctgaccgtctcgggtgcgtgggccaagcagatgttcacctgccgtgtggcacacactccatcgtccacagactgggtcgacaacaaaaccttcagcgtctgctccagggacttcaccccgcccaccgtgaagatcttacagtcgtcctgcgacggcggcgggcacttccccccgaccatccagctcctgtgcctcgtctctgggtacaccccagggactatcaacatcacctggctggaggacgggcaggtcatggacgtggacttgtccaccgcctctaccacgcaggagggtgagctggcctccacacaaagcgagctcaccctcagccagaagcactggctgtcagaccgcacctacacctgccaggtcacctatcaaggtcacacctttgaggacagcaccaagaagtgtgcagattccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccggtaaa

SEQ ID NO: 1409 - DNA, 204 bp, artificial sequence
  IGHE*03
gagctggacgtgtgcgtggaggaggccgagggcgaggcgccgtggacgtggaccggcctctgcatcttcgccgcactcttcctgctcagcgtgagctacagcgccgccctcacgctcctcatggtgcagcggttcctctcagccacgcggcaggggaggccccagacctccctcgactacaccaacgtcctccagccccacgcc

SEQ ID NO: 1410 - DNA, 1284 bp, artificial sequence
  IGHE*04
gcctccacacagagcccatccgtcttccccttgacccgctgctgcaaaaacattccctccaatgccacctccgtgactctgggctgcctggccacgggctacttcccggagccggtgatggtgacctgggacacaggctccctcaacgggacaactatgaccttaccagccaccaccctcacgctctctggtcactatgccaccatcagcttgctgaccgtctcgggtgcgtgggccaagcagatgttcacctgccgtgtggcacacactccatcgtccacagactgggtcgacaacaaaaccttcagcgtctgctccagggacttcaccccgcccaccgtgaagatcttacagtcgtcctgcgacggcggcgggcacttccccccgaccatccagctcctgtgcctcgtctctgggtacaccccagggactatcaacatcacctggctggaggacgggcaggtcatggacgtggacttgtccaccgcctctaccacgcaggagggtgagctggcctccacacaaagcgagctcaccctcagccagaagcactggctgtcagaccgcacctacacctgccaggtcacctatcaaggtcacacctttgaggacagcaccaagaagtgtgcagattccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcaagcccctcacagaccgtccagcgagcggtgtctgtaaatcccggtaaa

SEQ ID NO: 1411 - DNA, 1482 bp, artificial sequence
  IGHE*04
gcctccacacagagcccatccgtcttccccttgacccgctgctgcaaaaacattccctccaatgccacctccgtgactctgggctgcctggccacgggctacttcccggagccggtgatggtgacctgggacacaggctccctcaacgggacaactatgaccttaccagccaccaccctcacgctctctggtcactatgccaccatcagcttgctgaccgtctcgggtgcgtgggccaagcagatgttcacctgccgtgtggcacacactccatcgtccacagactgggtcgacaacaaaaccttcagcgtctgctccagggacttcaccccgcccaccgtgaagatcttacagtcgtcctgcgacggcggcgggcacttccccccgaccatccagctcctgtgcctcgtctctgggtacaccccagggactatcaacatcacctggctggaggacgggcaggtcatggacgtggacttgtccaccgcctctaccacgcaggagggtgagctggcctccacacaaagcgagctcaccctcagccagaagcactggctgtcagaccgcacctacacctgccaggtcacctatcaaggtcacacctttgaggacagcaccaagaagtgtgcagattccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcaagcccctcacagaccgtccagcgagcggtgtctgtaaatcccgagctggacgtgtgcgtggaggaggccgagggcgaggcgccgtggacgtggaccggcctctgcatcttcgccgcactcttcctgctcagcgtgagctacagcgccgccatcacgctcctcatggtgcagcggttcctctcagccacgcggcaggggaggccccagacctccctcgactacaccaacgtcctccagccccacgcc

SEQ ID NO: 1412 - DNA, 990 bp, artificial sequence
  IGHG1*02
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1413 - DNA, 990 bp, artificial sequence
  IGHG1*03
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaa

SEQ ID NO: 1414 - DNA, 978 bp, artificial sequence
  |IGHG2*0
gcctccaccaagggcccatcggtcttccccctggcgccctgctccaggagcacctccgagagcacagccgccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1415 - DNA, 1185 bp, artificial sequence
  IGHG2*01
gcctccaccaagggcccatcggtcttccccctggcgccctgctccaggagcacctccgagagcacagccgccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccggagctgcaactggaggagagctgtgcggaggcgcaggacggggagctggacgggctgtggacgaccatcaccatcttcatcacactcttcctgctaagcgtgtgctacagtgccaccatcaccttcttcaaggtgaagtggatcttctcctcagtggtggacctgaagcagaccatcgtccccgactacaggaacatgatcaggcagggggcc

SEQ ID NO: 1416 - DNA, 978 bp, artificial sequence
  IGHG2*02
gcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgacctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcatggaggtgcataatgccaagacaaagccacgggaggagcagttcaacagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaa

SEQ ID NO: 1417 - DNA, 978 bp, artificial sequence
  IGHG2*03
gcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1418 - DNA, 978 bp, artificial sequence
  IGHG2*04
gcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcagcttgggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1419 - DNA, 978 bp, artificial sequence
  IGHG2*05
gcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1420 - DNA, 978 bp, artificial sequence
  IGHG2*06
gcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatctccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaa

SEQ ID NO: 1421 - DNA, 1185 bp, artificial sequence
  IGHG2*06
gcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatctccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccggagctgcaactggaggagagctgtgcggaggcgcaggacggggagctggacgggctgtggaccaccatcaccatcttcatcacactcttcctgctaagcgtgtgctacagtgccaccatcaccttcttcaaggtgaagtggatcttctcctcagtggtggacctgaagcagaccatcgtccccgactacaggaacatgatcaggcagggggcc

SEQ ID NO: 1422 - DNA, 1131 bp, artificial sequence
  IGHG3*01
gcttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaa

SEQ ID NO: 1423 - DNA, 1338 bp, artificial sequence
  IGHG3*01
gcttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccggagctgcaactggaggagagctgtgcggaggcgcaggacggggagctggacgggctgtggacgaccatcaccatcttcatcacactcttcctgttaagcgtgtgctacagtgccaccgtcaccttcttcaaggtgaagtggatcttctcctcggtggtggacctgaagcagaccatcatccccgactataggaacatgattgggcagggggcc

SEQ ID NO: 1424 - DNA, 1086 bp, artificial sequence
  IGHG3*03
gcttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccgtgctggactccgacggctccttcttcctctacagcaggctaaccgtggacaagagcaggtggcaggaggggaatgtcttctcatgctccgtgatgcatgaggctctgcacaaccgcttcacgcagaagagcctctccctgtctccgggtaaa

SEQ ID NO: 1425 - DNA, 1293 bp, artificial sequence
  IGHG3*03
gcttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccgtgctggactccgacggctccttcttcctctacagcaggctaaccgtggacaagagcaggtggcaggaggggaatgtcttctcatgctccgtgatgcatgaggctctgcacaaccgcttcacgcagaagagcctctccctgtctccggagctgcaactggaggagagctgtgcggaggcgcaggacggggagctggacgggctgtggacgaccatcaccatcttgatcacactcttcctgttaagcgtgtgctacagtgccaccgtcaccttcttcaaggtgaagtggatcttctcctcggtggtggacctgaagcagaccatcatccccgactataggaacatgattgggcagggggcc

SEQ ID NO: 1426 - DNA, 1041 bp, artificial sequence
  IGHG3*04
gcctccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaa

SEQ ID NO: 1427 - DNA, 1131 bp, artificial sequence; identical to SEQ ID NO: 1422
  IGHG3*05

SEQ ID NO: 1428 - DNA, 1131 bp, artificial sequence
  IGHG3*06
gcttccaccaagggcccatcggtcttccccctggcgccctgctccaggagcacctctgggggcacagcggccctgggctgcctggtcaaggactacttcccagaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaagaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaa

SEQ ID NO: 1429 - DNA, 1131 bp, artificial sequence
  IGHG3*07
gcttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaagaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaa

SEQ ID NO: 1430 - DNA, 1131 bp, artificial sequence
  IGHG3*08
gcttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaa

SEQ ID NO: 1431 - DNA, 1131 bp, artificial sequence
  IGHG3*09
gcttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcgtgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcactgtggacaagagcaggtggcagcaggggaacatcttctcatgctccgtgatgcatgaggctctgcacaaccgcttcacgcagaagagcctctccctgtctccgggtaaa

SEQ ID NO: 1432 - DNA, 1131 bp, artificial sequence
  IGHG3*10
gcttccaccaagggcccatcggtcttccccctggcgccctgctccaggagcacctctgggggcacagcggccctgggctgcctggtcaaggactacttcccagaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaa

SEQ ID NO: 1433 - DNA, 1131 bp, artificial sequence
  IGHG3*11
gcttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccatgcccacggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagttcaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaa

SEQ ID NO: 1434 - DNA, 1086 bp, artificial sequence
  IGHG3*12
gcttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagttcaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaa

SEQ ID NO: 1435 - DNA, 1131 bp, artificial sequence
  IGHG3*13
gcttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaagaccacacctcccatgctggactccgacggctccttcttcctctacagcaagctcaccgtggacaagagcaggtggcaggaggggaacatcttctcatgctccgtgatgcatgaggctctgcacaaccgcttcacgcagaagagcctctccctgtctccgggtaaa

SEQ ID NO: 1436 - DNA, 1131 bp, artificial sequence
  IGHG3*14
gcttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagctgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgctacacgcagaagagcctctccctgtctccgggtaaa

SEQ ID NO: 1437 - DNA, 1131 bp, artificial sequence
  IGHG3*15
gcttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagctgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacatcttctcatgctccgtgatgcatgaggctctgcacaaccgctacacgcagaagagcctctccctgtctccgggtaaa

SEQ ID NO: 1438 - DNA, 1131 bp, artificial sequence
  IGHG3*16
gcttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagctgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaagccaaaggacagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgctacacgcagaagagcctctccctgtctccgggtaaa

SEQ ID NO: 1439 - DNA, 1086 bp, artificial sequence
  IGHG3*17
gcttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcaacttcggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccatggagtgggagagcagcgggcagccggagaacaactacaagaccacgcctcccgtgctggactccgacggctccttcttcctctacagcaagctcaccgtggacaagagcaggtggcagcaggggaacatcttctcatgctccgtgatgcatgaggctctgcacaaccactacacgcagaagagcctctccctgtctccgggtaaa

SEQ ID NO: 1440 - DNA, 1086 bp, artificial sequence
  IGHG3*18
gcttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtactcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgtgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccatggagtgggagagcagcgggcagccggagaacaactacaagaccacgcctcccgtgctggactccgacggctccttcttcctctacagcaagctcaccgtggacaagagcaggtggcagcaggggaacatcttctcatgctccgtgatgcatgaggctctgcacaaccactacacgcagaagagcctctccctgtctccgggtaaa

SEQ ID NO: 1441 - DNA, 1086 bp, artificial sequence
  IGHG3*19
gcttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgtgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccatggagtgggagagcagcgggcagccggagaacaactacaagaccacgcctcccgtgctggactccgacggctccttcttcctctacagcaagctcaccgtggacaagagcaggtggcagcaggggaacatcttctcatgctccgtgatgcatgaggctctgcacaaccactacacgcagaagagcctctccctgtctccgggtaaa

SEQ ID NO: 1442 - DNA, 981 bp, artificial sequence
  IGHG4*01
gcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaa

SEQ ID NO: 1443 - DNA, 687 bp, artificial sequence
  IGHG4*02
gagtccaaatatggtcccccgtgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcgtgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacgcagaagagcctctccctgtctctgggtaaa

SEQ ID NO: 1444 - DNA, 651 bp, artificial sequence
  IGHG4*03
gcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaagctcaccgtggacaagagcaggtggcaggaggggaacgtcttctcatgctccgtgatgcatgaggctctgcacaaccactacacgcagaagagcctctccctgtctctgggtaaa

SEQ ID NO: 1445 - DNA, 981 bp, artificial sequence
  IGHG4*04
gcttccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagagcctctccctgtctctgggtaaa

SEQ ID NO: 1446 - DNA, 1188 bp, artificial sequence
  IGHG4*04
gcttccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagagcctctccctgtctctggagctgcaactggaggagagctgtgcggaggcgcaggacggggagctggacgggctgtggacgaccatcaccatcttcatcacactcttcctgctaagcgtgtgctacagtgccaccgtcaccttcttcaaggtgaagtggatcttctcctcagtggtggacctgaagcagaccatcgtccccgactacaggaacatgataaggcagggggcc

SEQ ID NO: 1447 - DNA, 1419 bp, artificial sequence; identical to SEQ ID NO: 1380
  IGHM*01

SEQ ID NO: 1448 - DNA, 1359 bp, artificial sequence
  IGHM*03
gggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttccagtgattgctgagctgcctcccaaagtgagcgtcttcgtcccaccccgcgacggcttcttcggcaacccccgcaagtccaagctcatctgccaggccacgggtttcagtccccggcagattcaggtgtcctggctgcgcgaggggaagcaggtggggtctggcgtcaccacggaccaggtgcaggctgaggccaaagagtctgggcccacgacctacaaggtgaccagcacactgaccatcaaagagagcgactggctcagccagagcatgttcacctgccgcgtggatcacaggggcctgaccttccagcagaatgcgtcctccatgtgtgtccccgatcaagacacagccatccgggtcttcgccatccccccatcctttgccagcatcttcctcaccaagtccaccaagttgacctgcctggtcacagacctgaccacctatgacagcgtgaccatctcctggacccgccagaatggcgaagctgtgaaaacccacaccaacatctccgagagccaccccaatgccactttcagcgccgtgggtgaggccagcatctgcgaggatgactggaattccggggagaggttcacgtgcaccgtgacccacacagacctgccctcgccactgaagcagaccatctcccggcccaagggggtggccctgcacaggcccgatgtctacttgctgccaccagcccgggagcagctgaacctgcgggagtcggccaccatcacgtgcctggtgacgggcttctctcccgcggacgtcttcgtgcagtggatgcagagggggcagcccttgtccccggagaagtatgtgaccagcgccccaatgcctgagccccaggccccaggccggtacttcgcccacagcatcctgaccgtgtccgaagaggaatggaacacgggggagacctacacctgcgtggtggcccatgaggccctgcccaacagggtcaccgagaggaccgtggacaagtccaccggtaaacccaccctgtacaacgtgtccctggtcatgtccgacacagctggcacctgctac

SEQ ID NO: 1449 - DNA, 1422 bp, artificial sequence
  IGHM*03
gggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttccagtgattgctgagctgcctcccaaagtgagcgtcttcgtcccaccccgcgacggcttcttcggcaacccccgcaagtccaagctcatctgccaggccacgggtttcagtccccggcagattcaggtgtcctggctgcgcgaggggaagcaggtggggtctggcgtcaccacggaccaggtgcaggctgaggccaaagagtctgggcccacgacctacaaggtgaccagcacactgaccatcaaagagagcgactggctcagccagagcatgttcacctgccgcgtggatcacaggggcctgaccttccagcagaatgcgtcctccatgtgtgtccccgatcaagacacagccatccgggtcttcgccatccccccatcctttgccagcatcttcctcaccaagtccaccaagttgacctgcctggtcacagacctgaccacctatgacagcgtgaccatctcctggacccgccagaatggcgaagctgtgaaaacccacaccaacatctccgagagccaccccaatgccactttcagcgccgtgggtgaggccagcatctgcgaggatgactggaattccggggagaggttcacgtgcaccgtgacccacacagacctgccctcgccactgaagcagaccatctcccggcccaagggggtggccctgcacaggcccgatgtctacttgctgccaccagcccgggagcagctgaacctgcgggagtcggccaccatcacgtgcctggtgacgggcttctctcccgcggacgtcttcgtgcagtggatgcagagggggcagcccttgtccccggagaagtatgtgaccagcgccccaatgcctgagccccaggccccaggccggtacttcgcccacagcatcctgaccgtgtccgaagaggaatggaacacgggggagacctacacctgcgtggtggcccatgaggccctgcccaacagggtcaccgagaggaccgtggacaagtccaccgagggggaggtgagcgccgacgaggagggctttgagaacctgtgggccaccgcctccaccttcatcgtcctcttcctcctgagcctcttctacagtaccaccgtcaccttgttcaaggtgaaa

SEQ ID NO: 1450 - protein, 13 aa, Homo sapiens
  Top 50 TRA read sequence
CVVRATGTALIFG

SEQ ID NO: 1451 - protein, 14 aa, Homo sapiens
  Top 50 TRA read sequence
CAEGGTRAGEHLLL

SEQ ID NO: 1452 - protein, 13 aa, Homo sapiens
  Top 50 TRA read sequence
CVAYTGRRALTFG

SEQ ID NO: 1453 - protein, 14 aa, Homo sapiens
  Top 50 TRA read sequence
CIVLIQGAQKLVFG

SEQ ID NO: 1454 - protein, 14 aa, Homo sapiens
  Top 50 TRA read sequence
CAVNMDSNYQLIWG

SEQ ID NO: 1455 - protein, 15 aa, Homo sapiens
  Top 50 TRA read sequence
CAVETRGNTGKLIFG

SEQ ID NO: 1456 - protein, 14 aa, Homo sapiens
  Top 50 TRA read sequence
CVVSGPYNNDMRFG

SEQ ID NO: 1457 - protein, 15 aa, Homo sapiens
  Top 50 TRA read sequence
CAVAVVDSSYKLIFG

SEQ ID NO: 1458 - protein, 14 aa, Homo sapiens
  Top 50 TRA read sequence
CAGFYNQGGKLIFG

SEQ ID NO: 1459 - protein, 15 aa, Homo sapiens
  Top 50 TRA read sequence
CAVEDRAAGNKLTFG

SEQ ID NO: 1460 - protein, 15 aa, Homo sapiens
  Top 50 TRA read sequence
CALSSTNSGYALNFG

SEQ ID NO: 1461 - protein, 15 aa, Homo sapiens
  Top 50 TRA read sequence
CALRGNTNAGKSTFG

SEQ ID NO: 1462 - protein, 17 aa, Homo sapiens
  Top 50 TRA read sequence
CVVSARYSREEETNSPL

SEQ ID NO: 1463 - protein, 15 aa, Homo sapiens
  Top 50 TRA read sequence
CAENSKTSGSRLTFG

SEQ ID NO: 1464 - protein, 15 aa, Homo sapiens
  Top 50 TRA read sequence
CALSWDTGRRALTFG

SEQ ID NO: 1465 - protein, 12 aa, Homo sapiens
  Top 50 TRA read sequence
CVVTTVDDMRFG

SEQ ID NO: 1466 - protein, 13 aa, Homo sapiens
  Top 50 TRA read sequence
CSLSGSARQLTFG

SEQ ID NO: 1467 - protein, 14 aa, Homo sapiens
  Top 50 TRA read sequence
CAMRPFGNEKLTFG

SEQ ID NO: 1468 - protein, 14 aa, Homo sapiens
  Top 50 TRA read sequence
CALYGGATNKLIFG

SEQ ID NO: 1469 - protein, 15 aa, Homo sapiens
  Top 50 TRA read sequence
CAMSEGNAGNMLTFG

SEQ ID NO: 1470 - protein, 16 aa, Homo sapiens
  Top 50 TRA read sequence
CALSPLSGGSYIPTFG

SEQ ID NO: 1471 - protein, 14 aa, Homo sapiens
  Top 50 TRA read sequence
CVVRKYWRLQNYLW

SEQ ID NO: 1472 - protein, 17 aa, Homo sapiens
  Top 50 TRA read sequence
CALRFLPGGGYNKLIFG

SEQ ID NO: 1473 - protein, 16 aa, Homo sapiens
  Top 50 TRA read sequence
CALVPRRGATNKLIFG

SEQ ID NO: 1474 - protein, 11 aa, Homo sapiens
  Top 50 TRA read sequence
CAADDYKLSFG

SEQ ID NO: 1475 - protein, 14 aa, Homo sapiens
  Top 50 TRA read sequence
CANSGGSNYKLTFG

SEQ ID NO: 1476 - protein, 13 aa, Homo sapiens
  Top 50 TRA read sequence
CALDGNAGKSTFG

SEQ ID NO: 1477 - protein, 14 aa, Homo sapiens
  Top 50 TRA read sequence
CAASSSGGNMLTFG

SEQ ID NO: 1478 - protein, 13 aa, Homo sapiens
  Top 50 TRA read sequence
CALIGGYQKVTFG

SEQ ID NO: 1479 - protein, 9 aa, Homo sapiens
  Top 50 TRA read sequence
CALRVTCAL

SEQ ID NO: 1480 - protein, 15 aa, Homo sapiens
  Top 50 TRA read sequence
CAVVEGTGGFKTIFG

SEQ ID NO: 1481 - protein, 15 aa, Homo sapiens
  Top 50 TRA read sequence
CALGLMGNFNKFYFG

SEQ ID NO: 1482 - protein, 15 aa, Homo sapiens
  Top 50 TRA read sequence
CAVDRNTGGFKTIFG

SEQ ID NO: 1483 - protein, 13 aa, Homo sapiens
  Top 50 TRA read sequence
CAASRGANNLFFG

SEQ ID NO: 1484 - protein, 16 aa, Homo sapiens
  Top 50 TRA read sequence
CALRPNSNSGYALNFG

SEQ ID NO: 1485 - protein, 14 aa, Homo sapiens
  Top 50 TRA read sequence
CALNYNQGGKLIFG

SEQ ID NO: 1486 - protein, 11 aa, Homo sapiens
  Top 50 TRA read sequence
CAGNNNDMRFG

SEQ ID NO: 1487 - protein, 12 aa, Homo sapiens
  Top 50 TRA read sequence
CAVSNDYKLSFG

SEQ ID NO: 1488 - protein, 13 aa, Homo sapiens
  Top 50 TRA read sequence
CAVPFGNEKLTFG

SEQ ID NO: 1489 - protein, 15 aa, Homo sapiens
  Top 50 TRA read sequence
CALGASGSARQLTFG

SEQ ID NO: 1490 - protein, 14 aa, Homo sapiens
  Top 50 TRA read sequence
CALSDRAGNMLTFG

SEQ ID NO: 1491 - protein, 14 aa, Homo sapiens
  Top 50 TRA read sequence
CATHTGTASKLTFG

SEQ ID NO: 1492 - protein, 15 aa, Homo sapiens
  Top 50 TRA read sequence
CALPPSGGSYIPTFG

SEQ ID NO: 1493 - protein, 15 aa, Homo sapiens
  Top 50 TRA read sequence
CVVSPLTNAGKSTFG

SEQ ID NO: 1494 - protein, 15 aa, Homo sapiens
  Top 50 TRA read sequence
CATRRGTPMQANQPL

SEQ ID NO: 1495 - protein, 16 aa, Homo sapiens
  Top 50 TRA read sequence
CAVETSYSGTYKYIFG

SEQ ID NO: 1496 - protein, 17 aa, Homo sapiens
  Top 50 TRA read sequence
CIVRSHTTGTASKLTFG

SEQ ID NO: 1497 - protein, 11 aa, Homo sapiens
  Top 50 TRA read sequence
CASLFQKLVFG

SEQ ID NO: 1498 - protein, 16 aa, Homo sapiens
  Top 50 TRA read sequence
CAYRSENSGSPEAGIW

SEQ ID NO: 1499 - protein, 15 aa, Homo sapiens
  Top 50 TRA read sequence
CAVTFGDSNYQLIWG

SEQ ID NO: 1500 - protein, 15 aa, Homo sapiens
  Top 50 TRB read sequence
CSVERGGSLGEQYFG

SEQ ID NO: 1501 - protein, 15 aa, Homo sapiens
  Top 50 TRB read sequence
CSARTLAGHYEQYFG

SEQ ID NO: 1502 - protein, 16 aa, Homo sapiens
  Top 50 TRB read sequence
CASSYPGTGNHEQYFG

SEQ ID NO: 1503 - protein, 15 aa, Homo sapiens
  Top 50 TRB read sequence
CSVERGGSLGGAVLR

SEQ ID NO: 1504 - protein, 16 aa, Homo sapiens
  Top 50 TRB read sequence
CSANPGQQLQETQYFG

SEQ ID NO: 1505 - protein, 14 aa, Homo sapiens
  Top 50 TRB read sequence
CSVEREAPLGSSTS

SEQ ID NO: 1506 - protein, 14 aa, Homo sapiens
  Top 50 TRB read sequence
CSVERGGSLGEQTS

SEQ ID NO: 1507 - protein, 13 aa, Homo sapiens
  Top 50 TRB read sequence
CSVEERKGEQYFG

SEQ ID NO: 1508 - protein, 15 aa, Homo sapiens
  Top 50 TRB read sequence
CATSRDGQQETQYFG

SEQ ID NO: 1509 - protein, 14 aa, Homo sapiens
  Top 50 TRB read sequence
CSARTGDYYEQYFG

SEQ ID NO: 1510 - protein, 16 aa, Homo sapiens
  Top 50 TRB read sequence
CASSLAGGSYNEQFFG

SEQ ID NO: 1511 - protein, 14 aa, Homo sapiens
  Top 50 TRB read sequence
CSVSETGIYEQYFG

SEQ ID NO: 1512 - protein, 17 aa, Homo sapiens
  Top 50 TRB read sequence
CSASRGLAGGSYEQYFG

SEQ ID NO: 1513 - protein, 14 aa, Homo sapiens
  Top 50 TRB read sequence
  misc_feature (6)..(6): Xaa can be any naturally occurring amino acid
CSARTXRDIQQYFG

SEQ ID NO: 1514 - protein, 14 aa, Homo sapiens
  Top 50 TRB read sequence
CSALAGVGDTQYFG

SEQ ID NO: 1515 - protein, 15 aa, Homo sapiens
  Top 50 TRB read sequence
CSVERGRLPWGSSTS

SEQ ID NO: 1516 - protein, 16 aa, Homo sapiens
  Top 50 TRB read sequence
CSVEVLAGGPNEQFFG

SEQ ID NO: 1517 - protein, 23 aa, Homo sapiens
  Top 50 TRB read sequence
CSVTGTSGRATTSPSSYNEQFFG

SEQ ID NO: 1518 - protein, 16 aa, Homo sapiens
  Top 50 TRB read sequence
CSVATGGDGANVLTFG

SEQ ID NO: 1519 - protein, 17 aa, Homo sapiens
  Top 50 TRB read sequence
CSVGGLRDRPSYEQYFG

SEQ ID NO: 1520 - protein, 12 aa, Homo sapiens
  Top 50 TRB read sequence
CSQIEGDTQYFG

SEQ ID NO: 1521 - protein, 13 aa, Homo sapiens
  Top 50 TRB read sequence
CASSQTVYEQYFG

SEQ ID NO: 1522 - protein, 16 aa, Homo sapiens
  Top 50 TRB read sequence
CSAVEARKSSYEQYFG

SEQ ID NO: 1523 - protein, 16 aa, Homo sapiens
  Top 50 TRB read sequence
CSVGAGAGGTDTQYFG

SEQ ID NO: 1524 - protein, 15 aa, Homo sapiens
  Top 50 TRB read sequence
CSVERGRLPWGAVLR

SEQ ID NO: 1525 - protein, 12 aa, Homo sapiens
  Top 50 TRB read sequence
CASTSSETQYFG

SEQ ID NO: 1526 - protein, 14 aa, Homo sapiens
  Top 50 TRB read sequence
CSVERGGSLGSSTS

SEQ ID NO: 1527 - protein, 23 aa, Homo sapiens
  Top 50 TRB read sequence
CAISETPTSNNPHSSYNSPLHFG

SEQ ID NO: 1528 - protein, 15 aa, Homo sapiens
  Top 50 TRB read sequence
CASMVGPANTEAFFG

SEQ ID NO: 1529 - protein, 15 aa, Homo sapiens
  Top 50 TRB read sequence
CASSQYLISYEQYFG

SEQ ID NO: 1530 - protein, 15 aa, Homo sapiens
  Top 50 TRB read sequence
CSVGGVSSYNEQFFG

SEQ ID NO: 1531 - protein, 14 aa, Homo sapiens
  Top 50 TRB read sequence
CATSTQKNQPQHFG

SEQ ID NO: 1532 - protein, 14 aa, Homo sapiens
  Top 50 TRB read sequence
CSVEAGVGETQYFG

SEQ ID NO: 1533 - protein, 14 aa, Homo sapiens
  Top 50 TRB read sequence
CSAREGVGYGYTFG

SEQ ID NO: 1534 - protein, 16 aa, Homo sapiens
  Top 50 TRB read sequence
CASRHIAGEVNEQFFG

SEQ ID NO: 1535 - protein, 16 aa, Homo sapiens
  Top 50 TRB read sequence
CATSRDRQSDTEAFFG

SEQ ID NO: 1536 - protein, 13 aa, Homo sapiens
  Top 50 TRB read sequence
CSARDQTAEAFFG

SEQ ID NO: 1537 - protein, 15 aa, Homo sapiens
  Top 50 TRB read sequence
CASSVAARPYGYTFG

SEQ ID NO: 1538 - protein, 16 aa, Homo sapiens
  Top 50 TRB read sequence
CASSEVREALETPYIL

SEQ ID NO: 1539 - protein, 14 aa, Homo sapiens
  Top 50 TRB read sequence
CASTQNYAQPQHFG

SEQ ID NO: 1540 - protein, 16 aa, Homo sapiens
  Top 50 TRB read sequence
CATSGQGKTYNEQFFG

SEQ ID NO: 1541 - protein, 15 aa, Homo sapiens
  Top 50 TRB read sequence
CASSYTGTGDENCFW

SEQ ID NO: 1542 - protein, 9 aa, Homo sapiens
  Top 50 TRB read sequence
CSPDEAFFG

SEQ ID NO: 1543 - protein, 18 aa, Homo sapiens
  Top 50 TRB read sequence
CASSQDFRSVSGNTIYFG

SEQ ID NO: 1544 - protein, 15 aa, Homo sapiens
  Top 50 TRB read sequence
CASSLAGGVDTQYFG

SEQ ID NO: 1545 - protein, 15 aa, Homo sapiens
  Top 50 TRB read sequence
CASSGTSGRYEQYFG

SEQ ID NO: 1546 - protein, 15 aa, Homo sapiens
  Top 50 TRB read sequence
CSVVSWQVLDKSSSS

SEQ ID NO: 1547 - protein, 15 aa, Homo sapiens
  Top 50 TRB read sequence
CASSRPGQGLTQYFG

SEQ ID NO: 1548 - protein, 15 aa, Homo sapiens
  Top 50 TRB read sequence
  misc_feature (11)..(11): Xaa can be any naturally occurring amino acid
CSVERGGSLGXQYFG

SEQ ID NO: 1549 - protein, 15 aa, Homo sapiens
  Top 50 TRB read sequence
CASSQERGKYEQYFG

SEQ ID NO: 1550 - protein, 13 aa, Homo sapiens
  Duplicated TCRalpha strand read sequence in healthy people
CAVMDSNYQLIWG

SEQ ID NO: 1551 - protein, 13 aa, Homo sapiens
  Duplicated TCRalpha strand read sequence in healthy people
CAVRDGDYKLSFG

SEQ ID NO: 1552 - protein, 14 aa, Homo sapiens
  Duplicated TCRalpha strand read sequence in healthy people
CALSGGSNYKLTFG

SEQ ID NO: 1553 - protein, 13 aa, Homo sapiens
  Duplicated TCRalpha strand read sequence in healthy people
CAENTGGFKTIFG

SEQ ID NO: 1554 - protein, 13 aa, Homo sapiens
  Duplicated TCRalpha strand read sequence in healthy people
CAVRDSNYQLIWG

SEQ ID NO: 1555 - protein, 13 aa, Homo sapiens
  Duplicated TCRalpha strand read sequence in healthy people
CAVMDSSYKLIFG

SEQ ID NO: 1556 - protein, 13 aa, Homo sapiens
  Duplicated TCRalpha strand read sequence in healthy people
CAVTDSNYQLIWG

SEQ ID NO: 1557 - protein, 13 aa, Homo sapiens
  Duplicated TCRalpha strand read sequence in healthy people
CAVLDSNYQLIWG

SEQ ID NO: 1558 - protein, 13 aa, Homo sapiens
  Duplicated TCRalpha strand read sequence in healthy people
CAVRDRDYKLSFG

SEQ ID NO: 1559 - protein, 16 aa, Homo sapiens
  Duplicated TCRalpha strand read sequence in healthy people
CVVSDRGSTLGRLYFG

SEQ ID NO: 1560 - protein, 14 aa, Homo sapiens
  Duplicated TCRalpha strand read sequence in healthy people
CALIYNQGGKLIFG

SEQ ID NO: 1561 - protein, 11 aa, Homo sapiens
  Duplicated TCRalpha strand read sequence in healthy people
CALNDYKLSFG

SEQ ID NO: 1562 - protein, 15 aa, Homo sapiens
  Duplicated TCRalpha strand read sequence in healthy people
CAENSGGSNYKLTFG

SEQ ID NO: 1563 - protein, 13 aa, Homo sapiens
  Duplicated TCRalpha strand read sequence in healthy people
CAENNAGNMLTFG

SEQ ID NO: 1564 - protein, 13 aa, Homo sapiens
  Duplicated TCRalpha strand read sequence in healthy people
CAVNTGFQKLVFG

SEQ ID NO: 1565 - protein, 11 aa, Homo sapiens
  Duplicated TCRalpha strand read sequence in healthy people
CAVNDYKLSFG

SEQ ID NO: 1566 - protein, 11 aa, Homo sapiens
  Duplicated TCRalpha strand read sequence in healthy people
CVVNNARLMFG

SEQ ID NO: 1567 - protein, 13 aa, Homo sapiens
  Duplicated TCRalpha strand read sequence in healthy people
CAVKDSNYQLIWG

SEQ ID NO: 1568 - protein, 13 aa, Homo sapiens
  Duplicated TCRalpha strand read sequence in healthy people
CAAMDSNYQLIWG

SEQ ID NO: 1569 - protein, 13 aa, Homo sapiens
  Duplicated TCRalpha strand read sequence in healthy people
CAALDSNYQLIWG

SEQ ID NO: 1570 - protein, 13 aa, Homo sapiens
  Duplicated TCRalpha strand read sequence in healthy people
CALSGGSYIPTFG

SEQ ID NO: 1571 - protein, 16 aa, Homo sapiens
  Duplicated TCRalpha strand read sequence in healthy people
CALSDYGGSQGNLIFG

SEQ ID NO: 1572 - protein, 13 aa, Homo sapiens
  Duplicated TCRalpha strand read sequence in healthy people
CALIGFGNVLHCG

SEQ ID NO: 1573 - protein, 15 aa, Homo sapiens
  Duplicated TCRalpha strand read sequence in healthy people
CAVEEGTGGFKTIFG

SEQ ID NO: 1574 - protein, 14 aa, Homo sapiens
  Duplicated TCRalpha strand read sequence in healthy people
CAENTGTASKLTFG

SEQ ID NO: 1575 - protein, 14 aa, Homo sapiens
  Duplicated TCRalpha strand read sequence in healthy people
CAASGGSNYKLTFG

SEQ ID NO: 1576 - protein, 13 aa, Homo sapiens
  Duplicated TCRalpha strand read sequence in healthy people
CAVSGGSYIPTFG

SEQ ID NO: 1577 - protein, 12 aa, Homo sapiens
  Duplicated TCRalpha strand read sequence in healthy people
CAVNRDDKIIFG

SEQ ID NO: 1578 - protein, 13 aa, Homo sapiens
  Duplicated TCRalpha strand read sequence in healthy people
CAVNQAGTALIFG

SEQ ID NO: 1579 - protein, 14 aa, Homo sapiens
  Duplicated TCRalpha strand read sequence in healthy people
CAVNNQAGTALIFG

SEQ ID NO: 1580 - protein, 12 aa, Homo sapiens
  Duplicated TCRalpha strand read sequence in healthy people
CVVNTGNQFYFG

SEQ ID NO: 1581 - protein, 13 aa, Homo sapiens
  Duplicated TCRalpha strand read sequence in healthy people
CVVNQAGTALIFG

SEQ ID NO: 1582 - protein, 13 aa, Homo sapiens
  Duplicated TCRalpha strand read sequence in healthy people
CAVVDSNYQLIWG

SEQ ID NO: 1583 - protein, 13 aa, Homo sapiens
  Duplicated TCRalpha strand read sequence in healthy people
CAVSDSNYQLIWG

SEQ ID NO: 1584 - protein, 13 aa, Homo sapiens
  Duplicated TCRalpha strand read sequence in healthy people
CASMDSNYQLIWG

SEQ ID NO: 1585 - protein, 13 aa, Homo sapiens
  Duplicated TCRalpha strand read sequence in healthy people
CAPMDSNYQLIWG

SEQ ID NO: 1586 - protein, 13 aa, Homo sapiens
  Duplicated TCRalpha strand read sequence in healthy people
CAVRDSSYKLIFG

SEQ ID NO: 1587 - protein, 13 aa, Homo sapiens
  Duplicated TCRalpha strand read sequence in healthy people
CAVLDSSYKLIFG

SEQ ID NO: 1588 - protein, 14 aa, Homo sapiens
  Duplicated TCRbeta strand read sequence in healthy people
CASSVLRGGDPSTS

SEQ ID NO: 1589 - protein, 15 aa, Homo sapiens
  Duplicated TCRbeta strand read sequence in healthy people
CASSGEVGRETQYFG

SEQ ID NO: 1590 - protein, 14 aa, Homo sapiens
  Duplicated TCRbeta strand read sequence in healthy people
CASSYWGTGELFFG

SEQ ID NO: 1591 - protein, 13 aa, Homo sapiens
  Duplicated TCRbeta strand read sequence in healthy people
CASSYWGPGSCFL

SEQ ID NO: 1592 - protein, 15 aa, Homo sapiens
  Duplicated TCRbeta strand read sequence in healthy people
  misc_feature (1)..(1): Xaa can be any naturally occurring amino acid
XASSVGTKDQPQHFG

SEQ ID NO: 1593 - protein, 15 aa, Homo sapiens
  Duplicated TCRbeta strand read sequence in healthy people
  misc_feature (4)..(4): Xaa can be any naturally occurring amino acid
CASXVATWTGTATPS

SEQ ID NO: 1594 - protein, 16 aa, Homo sapiens
  Duplicated TCRbeta strand read sequence in healthy people
CASSVATLDRDGYTFG

SEQ ID NO: 1595 - protein, 14 aa, Homo sapiens
  Duplicated TCRbeta strand read sequence in healthy people
CASTQSTGLRVLLR

SEQ ID NO: 1596 - protein, 15 aa, Homo sapiens
  Duplicated TCRbeta strand read sequence in healthy people
CASSYRAATYEQYFG

SEQ ID NO: 1597 - protein, 17 aa, Homo sapiens
  Duplicated TCRbeta strand read sequence in healthy people
CASSLGLAGARYEQYFG

SEQ ID NO: 1598 - protein, 14 aa, Homo sapiens
  Duplicated TCRbeta strand read sequence in healthy people
CASSFRDSYEQYFG

SEQ ID NO: 1599 - protein, 15 aa, Homo sapiens
  Duplicated TCRbeta strand read sequence in healthy people
CASTGAPGANVLTFG

SEQ ID NO: 1600 - protein, 17 aa, Homo sapiens
  Duplicated TCRbeta strand read sequence in healthy people
CASSFPVPSGANVLTFG

SEQ ID NO: 1601 - protein, 19 aa, Homo sapiens
  Duplicated TCRbeta strand read sequence in healthy people
CASRAEHGSRRRGQRPDFR

SEQ ID NO: 1602 - protein, 13 aa, Homo sapiens
  Duplicated TCRbeta strand read sequence in healthy people
CASSLVGETQYFG

SEQ ID NO: 1603 - protein, 17 aa, Homo sapiens
  Duplicated TCRbeta strand read sequence in healthy people
CASSLGTSGSRNEQFFG

SEQ ID NO: 1604 - protein, 14 aa, Homo sapiens
  Duplicated TCRbeta strand read sequence in healthy people
CASSDSTTDTQYFG

SEQ ID NO: 1605 - protein, 16 aa, Homo sapiens
  Duplicated TCRbeta strand read sequence in healthy people
CASSDGTGGTDTQYFG

SEQ ID NO: 1606 - protein, 14 aa, Homo sapiens
  Duplicated TCRbeta strand read sequence in healthy people
CASSQGQGETQYFG

SEQ ID NO: 1607 - protein, 13 aa, Homo sapiens
  Duplicated TCRbeta strand read sequence in healthy people
CSVGQGPNEQYFG

SEQ ID NO: 1608 - protein, 14 aa, Homo sapiens
  Duplicated TCRbeta strand read sequence in healthy people
CSVAGTGAYEQYFG

SEQ ID NO: 1609 - protein, 12 aa, Homo sapiens
  Duplicated TCRbeta strand read sequence in healthy people
CSVAASYEQYFG

SEQ ID NO: 1610 - protein, 11 aa, Homo sapiens
  Duplicated TCRbeta strand read sequence in healthy people
CSVERETQYFG

SEQ ID NO: 1611 - protein, 12 aa, Homo sapiens
  Duplicated TCRbeta strand read sequence in healthy people
CSVDSKETQYFG

SEQ ID NO: 1612 - protein, 13 aa, Homo sapiens
  Duplicated TCRbeta strand read sequence in healthy people
CSVEGSTDTQYFG

SEQ ID NO: 1613 - protein, 13 aa, Homo sapiens
  Duplicated TCRbeta strand read sequence in healthy people
CSVEEGTDTQYFG

SEQ ID NO: 1614 - protein, 12 aa, Homo sapiens
  Duplicated TCRbeta strand read sequence in healthy people
CSVVGTGELFFG

SEQ ID NO: 1615 - protein, 15 aa, Homo sapiens
  Duplicated TCRbeta strand read sequence in healthy people
CSVAGTSGYNEQFFG

SEQ ID NO: 1616 - protein, 12 aa, Homo sapiens
  Duplicated TCRbeta strand read sequence in healthy people
CSVGTGNTIYFG

SEQ ID NO: 1617 - protein, 13 aa, Homo sapiens
  Duplicated TCRbeta strand read sequence in healthy people
CSVRGGNYGYTFG

SEQ ID NO: 1618 - protein, 13 aa, Homo sapiens
  Duplicated TCRbeta strand read sequence in healthy people
CSVGSGSYGYTFG

SEQ ID NO: 1619 - protein, 12 aa, Homo sapiens
  Duplicated TCRbeta strand read sequence in healthy people
CASSPSYEQYFG

SEQ ID NO: 1620 - protein, 14 aa, Homo sapiens
  Duplicated TCRbeta strand read sequence in healthy people
CASSLRGQETQYFG

SEQ ID NO: 1621 - protein, 12 aa, Homo sapiens
  Duplicated TCRbeta strand read sequence in healthy people
CASSLRETQYFG

SEQ ID NO: 1622 - protein, 13 aa, Homo sapiens
  Duplicated TCRbeta strand read sequence in healthy people
CASSLLTGELFFG

SEQ ID NO: 1623 - protein, 15 aa, Homo sapiens
  Duplicated TCRbeta strand read sequence in healthy people
CSASGTSVSYEQYFG

SEQ ID NO: 1624 - protein, 11 aa, Homo sapiens
  Duplicated TCRbeta strand read sequence in healthy people
CASSDNEQFFG

SEQ ID NO: 1625 - protein, 14 aa, Homo sapiens
  Duplicated TCRbeta strand read sequence in healthy people
CATSRDLGETQYFG

SEQ ID NO: 1626 - protein, 14 aa, Homo sapiens
  Duplicated TCRbeta strand read sequence in healthy people
CASSLAGNTEAFFG

SEQ ID NO: 1627 - protein, 14 aa, Homo sapiens
  Invariant TCR candidate gene sequence
CALSGGSNYKLTFG

SEQ ID NO: 1628 - protein, 13 aa, Homo sapiens
  Invariant TCR candidate gene sequence
CAENTGGFKTIFG

SEQ ID NO: 1629 - protein, 14 aa, Homo sapiens
  Invariant TCR candidate gene sequence
CALIYNQGGKLIFG

SEQ ID NO: 1630 - protein, 11 aa, Homo sapiens
  Invariant TCR candidate gene sequence
CALNDYKLSFG

SEQ ID NO: 1631 - protein, 15 aa, Homo sapiens
  Invariant TCR candidate gene sequence
CAENSGGSNYKLTFG

SEQ ID NO: 1632 - protein, 13 aa, Homo sapiens
  Invariant TCR candidate gene sequence
CAENNAGNMLTFG

SEQ ID NO: 1633 - protein, 13 aa, Homo sapiens
  Invariant TCR candidate gene sequence
CAVNTGFQKLVFG

SEQ ID NO: 1634 - protein, 11 aa, Homo sapiens
  Invariant TCR candidate gene sequence
CAVNDYKLSFG

SEQ ID NO: 1635 - protein, 11 aa, Homo sapiens
  Invariant TCR candidate gene sequence
CVVNNARLMFG

SEQ ID NO: 1636 - protein, 13 aa, Homo sapiens
  Invariant TCR candidate gene sequence
CALSGGSYIPTFG

SEQ ID NO: 1637 - protein, 16 aa, Homo sapiens
  Invariant TCR candidate gene sequence
CALSDYGGSQGNLIFG

SEQ ID NO: 1638 - protein, 13 aa, Homo sapiens
  Invariant TCR candidate gene sequence
CALIGFGNVLHCG

SEQ ID NO: 1639 - protein, 15 aa, Homo sapiens
  Invariant TCR candidate gene sequence
CAVEEGTGGFKTIFG

SEQ ID NO: 1640 - protein, 14 aa, Homo sapiens
  Invariant TCR candidate gene sequence
CAENTGTASKLTFG

SEQ ID NO: 1641 - protein, 14 aa, Homo sapiens
  Invariant TCR candidate gene sequence
CAASGGSNYKLTFG

SEQ ID NO: 1642 - protein, 13 aa, Homo sapiens
  Invariant TCR candidate gene sequence
CAVSGGSYIPTFG

SEQ ID NO: 1643 - protein, 12 aa, Homo sapiens
  Invariant TCR candidate gene sequence
CAVNRDDKIIFG

SEQ ID NO: 1644 - protein, 13 aa, Homo sapiens
  Invariant TCR candidate gene sequence
CAVNQAGTALIFG

SEQ ID NO: 1645 - protein, 14 aa, Homo sapiens
  Invariant TCR candidate gene sequence
CAVNNQAGTALIFG

SEQ ID NO: 1646 - protein, 12 aa, Homo sapiens
  Invariant TCR candidate gene sequence
CVVNTGNQFYFG

SEQ ID NO: 1647 - protein, 13 aa, Homo sapiens
  Invariant TCR candidate gene sequence
CVVNQAGTALIFG

SEQ ID NO: 1648 - protein, 13 aa, Homo sapiens
  Duplicated TCRalpha strand read sequence and cancer-specific TCRalpha read sequence in cancer patients
CAVMDSNYQLIWG

SEQ ID NO: 1649 - protein, 13 aa, Homo sapiens
  Duplicated TCRalpha strand read sequence and cancer-specific TCRalpha read sequence in cancer patients
CAVRDSNYQLIWG

SEQ ID NO: 1650 - protein, 13 aa, Homo sapiens
  Duplicated TCRalpha strand read sequence and cancer-specific TCRalpha read sequence in cancer patients
CAVLDSNYQLIWG

SEQ ID NO: 1651 - protein, 13 aa, Homo sapiens
  Duplicated TCRalpha strand read sequence and cancer-specific TCRalpha read sequence in cancer patients
CAVRDGDYKLSFG

SEQ ID NO: 1652 - protein, 13 aa, Homo sapiens
  Duplicated TCRalpha strand read sequence and cancer-specific TCRalpha read sequence in cancer patients
CAASKGGQKLLFA

SEQ ID NO: 1653 - protein, 13 aa, Homo sapiens
  Duplicated TCRalpha strand read sequence and cancer-specific TCRalpha read sequence in cancer patients
CAVKDSNYQLIWG

SEQ ID NO: 1654 - protein, 13 aa, Homo sapiens
  Duplicated TCRalpha strand read sequence and cancer-specific TCRalpha read sequence in cancer patients
CAAMDSNYQLIWG

SEQ ID NO: 1655 - protein, 14 aa, Homo sapiens
  Duplicated TCRalpha strand read sequence and cancer-specific TCRalpha read sequence in cancer patients
CALTQGGSEKLVFG

SEQ ID NO: 1656 - protein, 15 aa, Homo sapiens
  Duplicated TCRalpha strand read sequence and cancer-specific TCRalpha read sequence in cancer patients
CALSDQTGANNLFFG

SEQ ID NO: 1657 - protein, 14 aa, Homo sapiens
  Duplicated TCRalpha strand read sequence and cancer-specific TCRalpha read sequence in cancer patients
CALRKVRHRQAHLW

SEQ ID NO: 1658 - protein, 14 aa, Homo sapiens
  Duplicated TCRalpha strand read sequence and cancer-specific TCRalpha read sequence in cancer patients
CALRGYNFNKFYFG

SEQ ID NO: 1659 - protein, 11 aa, Homo sapiens
  Duplicated TCRalpha strand read sequence and cancer-specific TCRalpha read sequence in cancer patients
CALNDYKLSFG

SEQ ID NO: 1660 - protein, 16 aa, Homo sapiens
  Duplicated TCRalpha strand read sequence and cancer-specific TCRalpha read sequence in cancer patients
CLVGDRDTGRRALTFG

SEQ ID NO: 1661 - protein, 17 aa, Homo sapiens
  Duplicated TCRalpha strand read sequence and cancer-specific TCRalpha read sequence in cancer patients
CAYRSYSGGGADGLTFG

SEQ ID NO: 1662 - protein, 12 aa, Homo sapiens
  Duplicated TCRalpha strand read sequence and cancer-specific TCRalpha read sequence in cancer patients
CAVSGNTPLVFG

SEQ ID NO: 1663 - protein, 11 aa, Homo sapiens
  Duplicated TCRalpha strand read sequence and cancer-specific TCRalpha read sequence in cancer patients
CAVYGQNFVFG

SEQ ID NO: 1664 - protein, 16 aa, Homo sapiens
  Duplicated TCRalpha strand read sequence and cancer-specific TCRalpha read sequence in cancer patients
CAERVSSGSARQLTFG

SEQ ID NO: 1665 - protein, 13 aa, Homo sapiens
  Duplicated TCRalpha strand read sequence and cancer-specific TCRalpha read sequence in cancer patients
CAMNSGYSTLTFG

SEQ ID NO: 1666 - protein, 13 aa, Homo sapiens
  Duplicated TCRalpha strand read sequence and cancer-specific TCRalpha read sequence in cancer patients
CAALDSNYQLIWG

SEQ ID NO: 1667 - protein, 13 aa, Homo sapiens
  Duplicated TCRalpha strand read sequence and cancer-specific TCRalpha read sequence in cancer patients
CAVMDSSYKLIFG

SEQ ID NO: 1668 - protein, 16 aa, Homo sapiens
  Duplicated TCRalpha strand read sequence and cancer-specific TCRalpha read sequence in cancer patients
CVVSDRGSTLGRLYFG

SEQ ID NO: 1669 - protein, 15 aa, Homo sapiens
  Duplicated TCRalpha strand read sequence and cancer-specific TCRalpha read sequence in cancer patients
CALSLSGGSYIPTFG

SEQ ID NO: 1670 - protein, 14 aa, Homo sapiens
  Duplicated TCRalpha strand read sequence and cancer-specific TCRalpha read sequence in cancer patients
CALSDRGAQKLVFG

SEQ ID NO: 1671 - protein, 14 aa, Homo sapiens
  Duplicated TCRalpha strand read sequence and cancer-specific TCRalpha read sequence in cancer patients
CALIIGREPRSWYL

SEQ ID NO: 1672 - protein, 15 aa, Homo sapiens
  Duplicated TCRalpha strand read sequence and cancer-specific TCRalpha read sequence in cancer patients
CALIIGEGAQKLVFG

SEQ ID NO: 1673 - protein, 16 aa, Homo sapiens
  Duplicated TCRalpha strand read sequence and cancer-specific TCRalpha read sequence in cancer patients
CALSGSGGSNYKLTFG

SEQ ID NO: 1674 - protein, 17 aa, Homo sapiens
  Duplicated TCRalpha strand read sequence and cancer-specific TCRalpha read sequence in cancer patients
CALSDLSGGSNYKLTFG

SEQ ID NO: 1675 - protein, 16 aa, Homo sapiens
  Duplicated TCRalpha strand read sequence and cancer-specific TCRalpha read sequence in cancer patients
CALRAGGTSYGKLTFG

SEQ ID NO: 1676 - protein, 15 aa, Homo sapiens
  Duplicated TCRalpha strand read sequence and cancer-specific TCRalpha read sequence in cancer patients
CALTLTMGRRALTFG

SEQ ID NO: 1677 - protein, 13 aa, Homo sapiens
  Duplicated TCRalpha strand read sequence and cancer-specific TCRalpha read sequence in cancer patients
CALDFGNEKLTFG

SEQ ID NO: 1678 - protein, 11 aa, Homo sapiens
  Duplicated TCRalpha strand read sequence and cancer-specific TCRalpha read sequence in cancer patients
CAPPPHGLTFG

SEQ ID NO: 1679 - protein, 16 aa, Homo sapiens
  Duplicated TCRalpha strand read sequence and cancer-specific TCRalpha read sequence in cancer patients
CALSYSGGGADGLTFG

SEQ ID NO: 1680 - protein, 14 aa, Homo sapiens
  Duplicated TCRalpha strand read sequence and cancer-specific TCRalpha read sequence in cancer patients
CALRGGGADGLTFG

SEQ ID NO: 1681 - protein, 14 aa, Homo sapiens
  Duplicated TCRalpha strand read sequence and cancer-specific TCRalpha read sequence in cancer patients
CALNTGTASKLTFG

SEQ ID NO: 1682 - protein, 13 aa, Homo sapiens
  Duplicated TCRalpha strand read sequence and cancer-specific TCRalpha read sequence in cancer patients
CALSDRNNDMRFG

SEQ ID NO: 1683 - protein, 12 aa, Homo sapiens
  Duplicated TCRalpha strand read sequence and cancer-specific TCRalpha read sequence in cancer patients
CALRAGNMLTFG

SEQ ID NO: 1684 - protein, 14 aa, Homo sapiens
  Duplicated TCRalpha strand read sequence and cancer-specific TCRalpha read sequence in cancer patients
CALLNNAGNMLTFG

SEQ ID NO: 1685 - protein, 13 aa, Homo sapiens
  Duplicated TCRalpha strand read sequence and cancer-specific TCRalpha read sequence in cancer patients
CALSSNTGKLIFG

SEQ ID NO: 1686 - protein, 13 aa, Homo sapiens
  Duplicated TCRalpha strand read sequence and cancer-specific TCRalpha read sequence in cancer patients
CALSDNTDKLIFG

SEQ ID NO: 1687 - protein, 12 aa, Homo sapiens
  Duplicated TCRalpha strand read sequence and cancer-specific TCRalpha read sequence in cancer patients
CALIDTDKLIFG

SEQ ID NO: 1688 - protein, 14 aa, Homo sapiens
  Duplicated TCRalpha strand read sequence and cancer-specific TCRalpha read sequence in cancer patients
CALSGGATNKLIFG

SEQ ID NO: 1689 - protein, 12 aa, Homo sapiens
  Duplicated TCRalpha strand read sequence and cancer-specific TCRalpha read sequence in cancer patients
CALTSNARLMFG

SEQ ID NO: 1690 - protein, 12 aa, Homo sapiens
  Duplicated TCRalpha strand read sequence and cancer-specific TCRalpha read sequence in cancer patients
CALNNNARLMFG

SEQ ID NO: 1691 - protein, 15 aa, Homo sapiens
  Duplicated TCRalpha strand read sequence and cancer-specific TCRalpha read sequence in cancer patients
CALSSYSSASKIIFG

SEQ ID NO: 1692 - protein, 14 aa, Homo sapiens
  Duplicated TCRalpha strand read sequence and cancer-specific TCRalpha read sequence in cancer patients
CALSHSSASKIIFG

SEQ ID NO: 1693 - protein, 16 aa, Homo sapiens
  Duplicated TCRalpha strand read sequence and cancer-specific TCRalpha read sequence in cancer patients
CALSDRRSSASKIIFG

SEQ ID NO: 1694 - protein, 14 aa, Homo sapiens
  Duplicated TCRalpha strand read sequence and cancer-specific TCRalpha read sequence in cancer patients
CALRDSSASKIIFG

SEQ ID NO: 1695 - protein, 13 aa, Homo sapiens
  Duplicated TCRalpha strand read sequence and cancer-specific TCRalpha read sequence in cancer patients
CALVSGNTPLVFG

SEQ ID NO: 1696 - protein, 14 aa, Homo sapiens
  Duplicated TCRalpha strand read sequence and cancer-specific TCRalpha read sequence in cancer patients
CALRGSGNTPLVFG

SEQ ID NO: 1697 - protein, 16 aa, Homo sapiens
  Duplicated TCRalpha strand read sequence and cancer-specific TCRalpha read sequence in cancer patients
CALSDRDTNAGKSTFG

SEQ ID NO: 1698 - protein, 13 aa, Homo sapiens
  Duplicated TCRalpha strand read sequence and cancer-specific TCRalpha read sequence in cancer patients
CALNTNAGKSTFG

SEQ ID NO: 1699 - protein, 15 aa, Homo sapiens
  Duplicated TCRalpha strand read sequence and cancer-specific TCRalpha read sequence in cancer patients
CALSFYNQGGKLIFG

SEQ ID NO: 1700 - protein, 15 aa, Homo sapiens
  Duplicated TCRalpha strand read sequence and cancer-specific TCRalpha read sequence in cancer patients
CALSDYNQGGKLIFG

SEQ ID NO: 1701 - protein, 15 aa, Homo sapiens
  Duplicated TCRalpha strand read sequence and cancer-specific TCRalpha read sequence in cancer patients
CALPIYNQGGKLIFG

SEQ ID NO: 1702 - protein, 13 aa, Homo sapiens
  Duplicated TCRalpha strand read sequence and cancer-specific TCRalpha read sequence in cancer patients
CALAGSARQLTFG

SEQ ID NO: 1703 - protein, 13 aa, Homo sapiens
  Duplicated TCRalpha strand read sequence and cancer-specific TCRalpha read sequence in cancer patients
CAPRYNFNKFYFG

SEQ ID NO: 1704 - protein, 13 aa, Homo sapiens
  Duplicated TCRalpha strand read sequence and cancer-specific TCRalpha read sequence in cancer patients
CALSGDDYKLSFG

SEQ ID NO: 1705 - protein, 15 aa, Homo sapiens
  Duplicated TCRalpha strand read sequence and cancer-specific TCRalpha read sequence in cancer patients
CALSDKAAGNKLTFG

SEQ ID NO: 1706 - protein, 14 aa, Homo sapiens
  Duplicated TCRalpha strand read sequence and cancer-specific TCRalpha read sequence in cancer patients
CALFKAAGNKLTFG

SEQ ID NO: 1707 - protein, 14 aa, Homo sapiens
  Duplicated TCRalpha strand read sequence and cancer-specific TCRalpha read sequence in cancer patients
CALSDRDGQKLLFA

SEQ ID NO: 1708 - protein, 14 aa, Homo sapiens
  Duplicated TCRalpha strand read sequence and cancer-specific TCRalpha read sequence in cancer patients
CALSGQAGTALIFG

SEQ ID NO: 1709 - protein, 15 aa, Homo sapiens
  Duplicated TCRalpha strand read sequence and cancer-specific TCRalpha read sequence in cancer patients
CALSAVEAGTALIFG

SEQ ID NO: 1710 - protein, 15 aa, Homo sapiens
  Duplicated TCRalpha strand read sequence and cancer-specific TCRalpha read sequence in cancer patients
CALTPSGGYQKVTFG

SEQ ID NO: 1711 - protein, 15 aa, Homo sapiens
  Duplicated TCRalpha strand read sequence and cancer-specific TCRalpha read sequence in cancer patients
CALGGAGGGNKLTFG

SEQ ID NO: 1712 - protein, 17 aa, Homo sapiens
  Duplicated TCRalpha strand read sequence and cancer-specific TCRalpha read sequence in cancer patients
CAVVIETTGTASKLTFG

SEQ ID NO: 1713 - protein, 14 aa, Homo sapiens
  Duplicated TCRalpha strand read sequence and cancer-specific TCRalpha read sequence in cancer patients
CAVGALNNNDMRFG

SEQ ID NO: 1714 - protein, 14 aa, Homo sapiens
  Duplicated TCRalpha strand read sequence and cancer-specific TCRalpha read sequence in cancer patients
CAVGAAAGNKLTFG

SEQ ID NO: 1715 - protein, 15 aa, Homo sapiens
  Duplicated TCRalpha strand read sequence and cancer-specific TCRalpha read sequence in cancer patients
CVVSLSGGYNKLILE

SEQ ID NO: 1716 - protein, 14 aa, Homo sapiens
  Duplicated TCRalpha strand read sequence and cancer-specific TCRalpha read sequence in cancer patients
CAVQWWCYNKLIFG

SEQ ID NO: 1717 - protein, 15 aa, Homo sapiens
  Duplicated TCRalpha strand read sequence and cancer-specific TCRalpha read sequence in cancer patients
CALGSDGGSYIPTFG

SEQ ID NO: 1718 - protein, 15 aa, Homo sapiens
  Duplicated TCRalpha strand read sequence and cancer-specific TCRalpha read sequence in cancer patients
CALDISGNTGKLIFG

SEQ ID NO: 1719 - protein, 12 aa, Homo sapiens
  Duplicated TCRalpha strand read sequence and cancer-specific TCRalpha read sequence in cancer patients
CALGRFRQAHLW

SEQ ID NO: 1720 - protein, 19 aa, Homo sapiens
  Duplicated TCRalpha strand read sequence and cancer-specific TCRalpha read sequence in cancer patients
CAESRLTLYGHGQESTYFW

SEQ ID NO: 1721 - protein, 14 aa, Homo sapiens
  Duplicated TCRalpha strand read sequence and cancer-specific TCRalpha read sequence in cancer patients
CAERDTGRRALTFG

SEQ ID NO: 1722 - protein, 15 aa, Homo sapiens
  Duplicated TCRalpha strand read sequence and cancer-specific TCRalpha read sequence in cancer patients
CAESKRTGANNLFFG

SEQ ID NO: 1723 - protein, 12 aa, Homo sapiens
  Duplicated TCRalpha strand read sequence and cancer-specific TCRalpha read sequence in cancer patients
CLVGVEASKLSL

SEQ ID NO: 1724 - protein, 15 aa, Homo sapiens
  Duplicated TCRalpha strand read sequence and cancer-specific TCRalpha read sequence in cancer patients
CLVGTTSGTYKYIFG

SEQ ID NO: 1725 - protein, 15 aa, Homo sapiens
  Duplicated TCRalpha strand read sequence and cancer-specific TCRalpha read sequence in cancer patients
CLVGDTSNTGKLIFG

SEQ ID NO: 1726 - protein, 13 aa, Homo sapiens
  Duplicated TCRalpha strand read sequence and cancer-specific TCRalpha read sequence in cancer patients
CLDTSNTGKLIFG

SEQ ID NO: 1727 - protein, 13 aa, Homo sapiens
  Duplicated TCRalpha strand read sequence and cancer-specific TCRalpha read sequence in cancer patients
CLLTGSARQLTFG

SEQ ID NO: 1728 - protein, 17 aa, Homo sapiens
  Duplicated TCRalpha strand read sequence and cancer-specific TCRalpha read sequence in cancer patients
CAYRSGYGGATNKLIFG

SEQ ID NO: 1729 - protein, 15 aa, Homo sapiens
  Duplicated TCRalpha strand read sequence and cancer-specific TCRalpha read sequence in cancer patients
CAYRRRNNNARLMFG

SEQ ID NO: 1730 - protein, 17 aa, Homo sapiens
  Duplicated TCRalpha strand read sequence and cancer-specific TCRalpha read sequence in cancer patients
CAFMKHDWDSNYQLIWG

SEQ ID NO: 1731 - protein, 16 aa, Homo sapiens
  Duplicated TCRalpha strand read sequence and cancer-specific TCRalpha read sequence in cancer patients
CAFMTPGGATNKLIFG

SEQ ID NO: 1732 - protein, 13 aa, Homo sapiens
  Duplicated TCRalpha strand read sequence and cancer-specific TCRalpha read sequence in cancer patients
CAAIQGAQKLVFG

SEQ ID NO: 1733 - protein, 15 aa, Homo sapiens
  Duplicated TCRalpha strand read sequence and cancer-specific TCRalpha read sequence in cancer patients
CAGRPETSGSRLTFG

SEQ ID NO: 1734 - protein, 15 aa, Homo sapiens
  Duplicated TCRalpha strand read sequence and cancer-specific TCRalpha read sequence in cancer patients
CAGQGGGSNYKLTFG

SEQ ID NO: 1735 - protein, 16 aa, Homo sapiens
  Duplicated TCRalpha strand read sequence and cancer-specific TCRalpha read sequence in cancer patients
CAGQESGAGSYQLTFG

SEQ ID NO: 1736 - protein, 14 aa, Homo sapiens
  Duplicated TCRalpha strand read sequence and cancer-specific TCRalpha read sequence in cancer patients
CAGPDNYGQNFVFG

SEQ ID NO: 1737 - protein, 18 aa, Homo sapiens
  Duplicated TCRalpha strand read sequence and cancer-specific TCRalpha read sequence in cancer patients
CAVRDMRYGGSQGNLIFG

SEQ ID NO: 1738 - protein, 15 aa, Homo sapiens
  Duplicated TCRalpha strand read sequence and cancer-specific TCRalpha read sequence in cancer patients
CAVRDSGGYNKLYFW

SEQ ID NO: 1739 - protein, 15 aa, Homo sapiens
  Duplicated TCRalpha strand read sequence and cancer-specific TCRalpha read sequence in cancer patients
CAVRDSGGYNKLIFG

SEQ ID NO: 1740 - protein, 16 aa, Homo sapiens
  Duplicated TCRalpha strand read sequence and cancer-specific TCRalpha read sequence in cancer patients
CAVRAVNSGNTPLVFG

SEQ ID NO: 1741 - protein, 14 aa, Homo sapiens
  Duplicated TCRalpha strand read sequence and cancer-specific TCRalpha read sequence in cancer patients
CAASDSGTYKYIFG

SEQ ID NO: 1742 - protein, 13 aa, Homo sapiens
  Duplicated TCRalpha strand read sequence and cancer-specific TCRalpha read sequence in cancer patients
CAATEGNTPLVFG

SEQ ID NO: 1743 - protein, 14 aa, Homo sapiens
  Duplicated TCRalpha strand read sequence and cancer-specific TCRalpha read sequence in cancer patients
CTNPLGGNNRLAFG

SEQ ID NO: 1744 - protein, 16 aa, Homo sapiens
  Duplicated TCRalpha strand read sequence and cancer-specific TCRalpha read sequence in cancer patients
CILRDNTGTASKLTFG

SEQ ID NO: 1745 - protein, 13 aa, Homo sapiens
  Duplicated TCRalpha strand read sequence and cancer-specific TCRalpha read sequence in cancer patients
CILGGVWECAALR

SEQ ID NO: 1746 - protein, 13 aa, Homo sapiens
  Duplicated TCRalpha strand read sequence and cancer-specific TCRalpha read sequence in cancer patients
CILGGFGNVLHCG

SEQ ID NO: 1747 - protein, 13 aa, Homo sapiens
  Duplicated TCRalpha strand read sequence and cancer-specific TCRalpha read sequence in cancer patients
CILRVVLQTSSSL

SEQ ID NO: 1748 - protein, 16 aa, Homo sapiens
  Duplicated TCRalpha strand read sequence and cancer-specific TCRalpha read sequence in cancer patients
CILRDGHNQGGKLIFG

SEQ ID NO: 1749 - protein, 13 aa, Homo sapiens
  Duplicated TCRalpha strand read sequence and cancer-specific TCRalpha read sequence in cancer patients
CILMNNFNKFTLD

SEQ ID NO: 1750 - protein, 15 aa, Homo sapiens
  Duplicated TCRalpha strand read sequence and cancer-specific TCRalpha read sequence in cancer patients
CILTQRLNSGRLYFG

SEQ ID NO: 1751 - protein, 15 aa, Homo sapiens
  Duplicated TCRalpha strand read sequence and cancer-specific TCRalpha read sequence in cancer patients
CILTQRLNSGEAILW

SEQ ID NO: 1752 - protein, 16 aa, Homo sapiens
  Duplicated TCRalpha strand read sequence and cancer-specific TCRalpha read sequence in cancer patients
CIVRVAQGGSEKLVFG

SEQ ID NO: 1753 - protein, 18 aa, Homo sapiens
  Duplicated TCRalpha strand read sequence and cancer-specific TCRalpha read sequence in cancer patients
CIVRVSAGGTSYGKLTFG

SEQ ID NO: 1754 - protein, 15 aa, Homo sapiens
  Duplicated TCRalpha strand read sequence and cancer-specific TCRalpha read sequence in cancer patients
CIVTAYTGRRALTLG

SEQ ID NO: 1755 - protein, 15 aa, Homo sapiens
  Duplicated TCRalpha strand read sequence and cancer-specific TCRalpha read sequence in cancer patients
CIVTAYTGRRALTFG

SEQ ID NO: 1756 - protein, 15 aa, Homo sapiens
  Duplicated TCRalpha strand read sequence and cancer-specific TCRalpha read sequence in cancer patients
CIVRVPNTGNQFYFG

SEQ ID NO: 1757 - protein, 16 aa, Homo sapiens
  Duplicated TCRalpha strand read sequence and cancer-specific TCRalpha read sequence in cancer patients
CIVRADTGTASKLTFG

SEQ ID NO: 1758 - protein, 14 aa, Homo sapiens
  Duplicated TCRalpha strand read sequence and cancer-specific TCRalpha read sequence in cancer patients
CIVRVDNTDKLIFG

SEQ ID NO: 1759 - protein, 14 aa, Homo sapiens
  Duplicated TCRalpha strand read sequence and cancer-specific TCRalpha read sequence in cancer patients
CAGSLRGYQKVTFG

SEQ ID NO: 1760 - protein, 13 aa, Homo sapiens
  Duplicated TCRalpha strand read sequence and cancer-specific TCRalpha read sequence in cancer patients
CAGMDSSYKLIFG

SEQ ID NO: 1761 - protein, 14 aa, Homo sapiens
  Duplicated TCRalpha strand read sequence and cancer-specific TCRalpha read sequence in cancer patients
CAVGNTGGFKTIFG

SEQ ID NO: 1762 - protein, 13 aa, Homo sapiens
  Duplicated TCRalpha strand read sequence and cancer-specific TCRalpha read sequence in cancer patients
CAVKGGSYIPTFG

SEQ ID NO: 1763 - protein, 14 aa, Homo sapiens
  Duplicated TCRalpha strand read sequence and cancer-specific TCRalpha read sequence in cancer patients
CAVNHFGNEKLTFG

SEQ ID NO: 1764 - protein, 14 aa, Homo sapiens
  Duplicated TCRalpha strand read sequence and cancer-specific TCRalpha read sequence in cancer patients
CAVSTGTASKLTFG

SEQ ID NO: 1765 - protein, 15 aa, Homo sapiens
  Duplicated TCRalpha strand read sequence and cancer-specific TCRalpha read sequence in cancer patients
CAVRGTGTASKLTFG

SEQ ID NO: 1766 - protein, 14 aa, Homo sapiens
  Duplicated TCRalpha strand read sequence and cancer-specific TCRalpha read sequence in cancer patients
CAVARGSGYALNFG

SEQ ID NO: 1767 - protein, 13 aa, Homo sapiens
  Duplicated TCRalpha strand read sequence and cancer-specific TCRalpha read sequence in cancer patients
CAVNSGNTPLVFG

SEQ ID NO: 1768 - protein, 12 aa, Homo sapiens
  Duplicated TCRalpha strand read sequence and cancer-specific TCRalpha read sequence in cancer patients
CAVNYGQNFVFG

SEQ ID NO: 1769 - protein, 14 aa, Homo sapiens
  Duplicated TCRalpha strand read sequence and cancer-specific TCRalpha read sequence in cancer patients
CAVPFWFCKATDLW

SEQ ID NO: 1770 - protein, 14 aa, Homo sapiens
  Duplicated TCRalpha strand read sequence and cancer-specific TCRalpha read sequence in cancer patients
CAVGSGGGNKLTFG

SEQ ID NO: 1771 - protein, 13 aa, Homo sapiens
  Duplicated TCRalpha strand read sequence and cancer-specific TCRalpha read sequence in cancer patients
CAVQGGSEKLVFG

SEQ ID NO: 1772 - protein, 16 aa, Homo sapiens
  Duplicated TCRalpha strand read sequence and cancer-specific TCRalpha read sequence in cancer patients
CAVQVRGTSYGKLTFG

SEQ ID NO: 1773 - protein, 13 aa, Homo sapiens
  Duplicated TCRalpha strand read sequence and cancer-specific TCRalpha read sequence in cancer patients
CAVSGSARQLTFG

SEQ ID NO: 1774 - protein, 15 aa, Homo sapiens
  Duplicated TCRalpha strand read sequence and cancer-specific TCRalpha read sequence in cancer patients
CAVEGTGGSYIPTFG

SEQ ID NO: 1775 - protein, 11 aa, Homo sapiens
  Duplicated TCRalpha strand read sequence and cancer-specific TCRalpha read sequence in cancer patients
FPHGQESTYFW

SEQ ID NO: 1776 - protein, 15 aa, Homo sapiens
  Duplicated TCRalpha strand read sequence and cancer-specific TCRalpha read sequence in cancer patients
CAVDMDTGRRALTFG

SEQ ID NO: 1777 - protein, 15 aa, Homo sapiens
  Duplicated TCRalpha strand read sequence and cancer-specific TCRalpha read sequence in cancer patients
CAVGNTGTASKLTFG

SEQ ID NO: 1778 - protein, 12 aa, Homo sapiens
  Duplicated TCRalpha strand read sequence and cancer-specific TCRalpha read sequence in cancer patients
CAVEDNNDMRFG

SEQ ID NO: 1779 - protein, 15 aa, Homo sapiens
  Duplicated TCRalpha strand read sequence and cancer-specific TCRalpha read sequence in cancer patients
CAVDYGGSQGNLIFG

SEQ ID NO: 1780 - protein, 15 aa, Homo sapiens
  Duplicated TCRalpha strand read sequence and cancer-specific TCRalpha read sequence in cancer patients
CAVEWSSNTGKLIFG

SEQ ID NO: 1781 - protein, 13 aa, Homo sapiens
  Duplicated TCRalpha strand read sequence and cancer-specific TCRalpha read sequence in cancer patients
CAVPYNTDKLIFG

SEQ ID NO: 1782 - protein, 11 aa, Homo sapiens
  Duplicated TCRalpha strand read sequence and cancer-specific TCRalpha read sequence in cancer patients
CAVAVDKLIFG

SEQ ID NO: 1783 - protein, 15 aa, Homo sapiens
  Duplicated TCRalpha strand read sequence and cancer-specific TCRalpha read sequence in cancer patients
CAVKRGDSNYQLIWG

SEQ ID NO: 1784 - protein, 12 aa, Homo sapiens
  Duplicated TCRalpha strand read sequence and cancer-specific TCRalpha read sequence in cancer patients
CAVEDNYQLIWG

SEQ ID NO: 1785 - protein, 12 aa, Homo sapiens
  Duplicated TCRalpha strand read sequence and cancer-specific TCRalpha read sequence in cancer patients
CAVDSNYQLIWG

SEQ ID NO: 1786 - protein, 12 aa, Homo sapiens
  Duplicated TCRalpha strand read sequence and cancer-specific TCRalpha read sequence in cancer patients
CAVELNARLMFG

SEQ ID NO: 1787 - protein, 14 aa, Homo sapiens
  Duplicated TCRalpha strand read sequence and cancer-specific TCRalpha read sequence in cancer patients
CAVEDRRDDKIIFG

SEQ ID NO: 1788 - protein, 16 aa, Homo sapiens
  Duplicated TCRalpha strand read sequence and cancer-specific TCRalpha read sequence in cancer patients
CAVEDQNSSASKIIFG

SEQ ID NO: 1789 - protein, 14 aa, Homo sapiens
  Duplicated TCRalpha strand read sequence and cancer-specific TCRalpha read sequence in cancer patients
CAVALQQCFQDNLW

SEQ ID NO: 1790 - protein, 11 aa, Homo sapiens
  Duplicated TCRalpha strand read sequence and cancer-specific TCRalpha read sequence in cancer patients
CAANAGKSTFG

SEQ ID NO: 1791 - protein, 13 aa, Homo sapiens
  Duplicated TCRalpha strand read sequence and cancer-specific TCRalpha read sequence in cancer patients
CAVYNYGQNFVFG

SEQ ID NO: 1792 - protein, 15 aa, Homo sapiens
  Duplicated TCRalpha strand read sequence and cancer-specific TCRalpha read sequence in cancer patients
CAVEDRNYGQNFVFG

SEQ ID NO: 1793 - protein, 13 aa, Homo sapiens
  Duplicated TCRalpha strand read sequence and cancer-specific TCRalpha read sequence in cancer patients
CAVDNYGQNFVFG

SEQ ID NO: 1794 - protein, 13 aa, Homo sapiens
  Duplicated TCRalpha strand read sequence and cancer-specific TCRalpha read sequence in cancer patients
CAADNYGQNFVFG

SEQ ID NO: 1795 - protein, 13 aa, Homo sapiens
  Duplicated TCRalpha strand read sequence and cancer-specific TCRalpha read sequence in cancer patients
CAVESAARQLTFG

SEQ ID NO: 1796 - protein, 13 aa, Homo sapiens
  Duplicated TCRalpha strand read sequence and cancer-specific TCRalpha read sequence in cancer patients
CAVSSNDYKLSFG

SEQ ID NO: 1797 - protein, 14 aa, Homo sapiens
  Duplicated TCRalpha strand read sequence and cancer-specific TCRalpha read sequence in cancer patients
CAVPNQAGTALIFG

SEQ ID NO: 1798 - protein, 14 aa, Homo sapiens
  Duplicated TCRalpha strand read sequence and cancer-specific TCRalpha read sequence in cancer patients
CAVANQAGTALIFG

SEQ ID NO: 1799 - protein, 15 aa, Homo sapiens
  Duplicated TCRalpha strand read sequence and cancer-specific TCRalpha read sequence in cancer patients
CAVLNSGGYQKVTFG

SEQ ID NO: 1800 - protein, 14 aa, Homo sapiens
  Duplicated TCRalpha strand read sequence and cancer-specific TCRalpha read sequence in cancer patients
CALSEFSGYALNFG

SEQ ID NO: 1801 - protein, 14 aa, Homo sapiens
  Duplicated TCRalpha strand read sequence and cancer-specific TCRalpha read sequence in cancer patients
CATVSNRDDKIIFG

SEQ ID NO: 1802 - protein, 15 aa, Homo sapiens
  Duplicated TCRalpha strand read sequence and cancer-specific TCRalpha read sequence in cancer patients
CALATQGGSEKLVFG

SEQ ID NO: 1803 - protein, 14 aa, Homo sapiens
  Duplicated TCRalpha strand read sequence and cancer-specific TCRalpha read sequence in cancer patients
CALSLKYGNKLVFG

SEQ ID NO: 1804 - protein, 18 aa, Homo sapiens
  Duplicated TCRalpha strand read sequence and cancer-specific TCRalpha read sequence in cancer patients
CAMREPWNSGSARQLTFG

SEQ ID NO: 1805 - protein, 15 aa, Homo sapiens
  Duplicated TCRalpha strand read sequence and cancer-specific TCRalpha read sequence in cancer patients
CAENPTGGSYIPTFG

SEQ ID NO: 1806 - protein, 15 aa, Homo sapiens
  Duplicated TCRalpha strand read sequence and cancer-specific TCRalpha read sequence in cancer patients
CAESPTGANSKLTFG

SEQ ID NO: 1807 - protein, 15 aa, Homo sapiens
  Duplicated TCRalpha strand read sequence and cancer-specific TCRalpha read sequence in cancer patients
CAEPRRGGADGLTFG

SEQ ID NO: 1808 - protein, 13 aa, Homo sapiens
  Duplicated TCRalpha strand read sequence and cancer-specific TCRalpha read sequence in cancer patients
CAENNAGNMLTFG

SEQ ID NO: 1809 - protein, 14 aa, Homo sapiens
  Duplicated TCRalpha strand read sequence and cancer-specific TCRalpha read sequence in cancer patients
CAENIKNTDKLIFG

SEQ ID NO: 1810 - protein, 13 aa, Homo sapiens
  Duplicated TCRalpha strand read sequence and cancer-specific TCRalpha read sequence in cancer patients
CAERGGINKFYFG

SEQ ID NO: 1811 - protein, 13 aa, Homo sapiens
  Duplicated TCRalpha strand read sequence and cancer-specific TCRalpha read sequence in cancer patients
CAENQAGTALIFG

SEQ ID NO: 1812 - protein, 13 aa, Homo sapiens
  Duplicated TCRalpha strand read sequence and cancer-specific TCRalpha read sequence in cancer patients
CAASKGGFKTIFG

SEQ ID NO: 1813 - protein, 15 aa, Homo sapiens
  Duplicated TCRalpha strand read sequence and cancer-specific TCRalpha read sequence in cancer patients
CAAAGGTSYGKLTFG

SEQ ID NO: 1814 - protein, 13 aa, Homo sapiens
  Duplicated TCRalpha strand read sequence and cancer-specific TCRalpha read sequence in cancer patients
CAADTGRRALTFG

SEQ ID NO: 1815 - protein, 17 aa, Homo sapiens
  Duplicated TCRalpha strand read sequence and cancer-specific TCRalpha read sequence in cancer patients
CAASSYSGGGADGLTFG

SEQ ID NO: 1816 - protein, 16 aa, Homo sapiens
  Duplicated TCRalpha strand read sequence and cancer-specific TCRalpha read sequence in cancer patients
CAAPRVGGGADGLTFG

SEQ ID NO: 1817 - protein, 14 aa, Homo sapiens
  Duplicated TCRalpha strand read sequence and cancer-specific TCRalpha read sequence in cancer patients
CAASKRSNYQLIWG

SEQ ID NO: 1818 - protein, 14 aa, Homo sapiens
  Duplicated TCRalpha strand read sequence and cancer-specific TCRalpha read sequence in cancer patients
CAASKGSNYQLIWG

SEQ ID NO: 1819 - protein, 15 aa, Homo sapiens
  Duplicated TCRalpha strand read sequence and cancer-specific TCRalpha read sequence in cancer patients
CAASYGGATNKLIFG

SEQ ID NO: 1820 - protein, 14 aa, Homo sapiens
  Duplicated TCRalpha strand read sequence and cancer-specific TCRalpha read sequence in cancer patients
CAARGSSASKIIFG

SEQ ID NO: 1821 - protein, 14 aa, Homo sapiens
  Duplicated TCRalpha strand read sequence and cancer-specific TCRalpha read sequence in cancer patients
CAATYRNAGKSTFG

SEQ ID NO: 1822 - protein, 15 aa, Homo sapiens
  Duplicated TCRalpha strand read sequence and cancer-specific TCRalpha read sequence in cancer patients
CAASLYNQGGKLIFG

SEQ ID NO: 1823 - protein, 14 aa, Homo sapiens
  Duplicated TCRalpha strand read sequence and cancer-specific TCRalpha read sequence in cancer patients
CAASRGNFNKFYFG

SEQ ID NO: 1824 - protein, 13 aa, Homo sapiens
  Duplicated TCRalpha strand read sequence and cancer-specific TCRalpha read sequence in cancer patients
CAAQKGDYKLSFG

SEQ ID NO: 1825 - protein, 14 aa, Homo sapiens
  Duplicated TCRalpha strand read sequence and cancer-specific TCRalpha read sequence in cancer patients
CAASNQAGTALIFG

SEQ ID NO: 1826 - protein, 13 aa, Homo sapiens
  Duplicated TCRalpha strand read sequence and cancer-specific TCRalpha read sequence in cancer patients
CAANQAGTALIFG

SEQ ID NO: 1827 - protein, 13 aa, Homo sapiens
  Duplicated TCRalpha strand read sequence and cancer-specific TCRalpha read sequence in cancer patients
CAATREEETNSPL

SEQ ID NO: 1828 - protein, 15 aa, Homo sapiens
  Duplicated TCRalpha strand read sequence and cancer-specific TCRalpha read sequence in cancer patients
CAMSASSNTGKLIFG

SEQ ID NO: 1829 - protein, 12 aa, Homo sapiens
  Duplicated TCRalpha strand read sequence and cancer-specific TCRalpha read sequence in cancer patients
CAMNNNARLMFG

SEQ ID NO: 1830 - protein, 15 aa, Homo sapiens
  Duplicated TCRalpha strand read sequence and cancer-specific TCRalpha read sequence in cancer patients
CAMRGIRDAGKSTFG

SEQ ID NO: 1831 - protein, 15 aa, Homo sapiens
  Duplicated TCRalpha strand read sequence and cancer-specific TCRalpha read sequence in cancer patients
CAMSAYNQGGKLIFG

SEQ ID NO: 1832 - protein, 16 aa, Homo sapiens
  Duplicated TCRalpha strand read sequence and cancer-specific TCRalpha read sequence in cancer patients
CAMSEGRHNFNKFTLD

SEQ ID NO: 1833 - protein, 12 aa, Homo sapiens
  Duplicated TCRalpha strand read sequence and cancer-specific TCRalpha read sequence in cancer patients
CAMTGYSTLTFG

SEQ ID NO: 1834 - protein, 13 aa, Homo sapiens
  Duplicated TCRalpha strand read sequence and cancer-specific TCRalpha read sequence in cancer patients
CAVYRRKLHTYIW

SEQ ID NO: 1835 - protein, 13 aa, Homo sapiens
  Duplicated TCRalpha strand read sequence and cancer-specific TCRalpha read sequence in cancer patients
CAVYSSASKIIFG

SEQ ID NO: 1836 - protein, 13 aa, Homo sapiens
  Duplicated TCRalpha strand read sequence and cancer-specific TCRalpha read sequence in cancer patients
CGLNTGGFKTIFG

SEQ ID NO: 1837 - protein, 14 aa, Homo sapiens
  Duplicated TCRalpha strand read sequence and cancer-specific TCRalpha read sequence in cancer patients
CVVNEGGSYIPTFG

SEQ ID NO: 1838 - protein, 17 aa, Homo sapiens
  Duplicated TCRalpha strand read sequence and cancer-specific TCRalpha read sequence in cancer patients
CVVPLLMDTGRRALTFG

SEQ ID NO: 1839 - protein, 15 aa, Homo sapiens
  Duplicated TCRalpha strand read sequence and cancer-specific TCRalpha read sequence in cancer patients
CVVNMDTGRRALTFG

SEQ ID NO: 1840 - protein, 15 aa, Homo sapiens
  Duplicated TCRalpha strand read sequence and cancer-specific TCRalpha read sequence in cancer patients
CVLKPRGSQGNLIFG

SEQ ID NO: 1841 - protein, 14 aa, Homo sapiens
  Duplicated TCRalpha strand read sequence and cancer-specific TCRalpha read sequence in cancer patients
CVVNSPGANNLFFG

SEQ ID NO: 1842 - protein, 13 aa, Homo sapiens
  Duplicated TCRalpha strand read sequence and cancer-specific TCRalpha read sequence in cancer patients
CVVNDYGQNFVFG

SEQ ID NO: 1843 - protein, 11 aa, Homo sapiens
  Duplicated TCRalpha strand read sequence and cancer-specific TCRalpha read sequence in cancer patients
CAVNDYKLSFG

SEQ ID NO: 1844 - protein, 14 aa, Homo sapiens
  Duplicated TCRalpha strand read sequence and cancer-specific TCRalpha read sequence in cancer patients
CAVRDSSNYQLIWG

SEQ ID NO: 1845 - protein, 13 aa, Homo sapiens
  Duplicated TCRalpha strand read sequence and cancer-specific TCRalpha read sequence in cancer patients
CAVRDGNYQLIWG

SEQ ID NO: 1846 - protein, 13 aa, Homo sapiens
  Duplicated TCRalpha strand read sequence and cancer-specific TCRalpha read sequence in cancer patients
CAVMDSNYQLIWA

SEQ ID NO: 1847 - protein, 13 aa, Homo sapiens
  Duplicated TCRalpha strand read sequence and cancer-specific TCRalpha read sequence in cancer patients
CAVLDSNYQLIWA

SEQ ID NO: 1848 - protein, 13 aa, Homo sapiens
  Duplicated TCRalpha strand read sequence and cancer-specific TCRalpha read sequence in cancer patients
CATMDSNYQLIWG

SEQ ID NO: 1849 - protein, 16 aa, Homo sapiens
  Duplicated TCRalpha strand read sequence and cancer-specific TCRalpha read sequence in cancer patients
CAVRDHGGATNKLIFG

SEQ ID NO: 1850 - protein, 14 aa, Homo sapiens
  Duplicated TCRalpha strand read sequence and cancer-specific TCRalpha read sequence in cancer patients
CAVRGQAGTALIFG

SEQ ID NO: 1851 - protein, 13 aa, Homo sapiens
  Duplicated TCRalpha strand read sequence and cancer-specific TCRalpha read sequence in cancer patients
CASLDSSYKLIFG

SEQ ID NO: 1852 - protein, 13 aa, Homo sapiens
  Duplicated TCRalpha strand read sequence and cancer-specific TCRalpha read sequence in cancer patients
CAVRDSNYQLIWG

SEQ ID NO: 1853 - protein, 16 aa, Homo sapiens
  Duplicated TCRalpha strand read sequence and cancer-specific TCRalpha read sequence in cancer patients
CAVRDSRRGNTPLVFG

SEQ ID NO: 1854 - protein, 16 aa, Homo sapiens
  Duplicated TCRalpha strand read sequence and cancer-specific TCRalpha read sequence in cancer patients
CAVREPNTNAGKSTFG

SEQ ID NO: 1855 - protein, 13 aa, Homo sapiens
  Duplicated TCRalpha strand read sequence and cancer-specific TCRalpha read sequence in cancer patients
CAVKAAGNKLTFG

SEQ ID NO: 1856 - protein, 17 aa, Homo sapiens
  Duplicated TCRalpha strand read sequence and cancer-specific TCRalpha read sequence in cancer patients
CVVTLTMNTGFQKLVFG

SEQ ID NO: 1857 - protein, 14 aa, Homo sapiens
  Duplicated TCRalpha strand read sequence and cancer-specific TCRalpha read sequence in cancer patients
CVVPTSGTYKYIFG

SEQ ID NO: 1858 - protein, 17 aa, Homo sapiens
  Duplicated TCRalpha strand read sequence and cancer-specific TCRalpha read sequence in cancer patients
CVVTPSRAGGYNKLILE

SEQ ID NO: 1859 - protein, 16 aa, Homo sapiens
  Duplicated TCRalpha strand read sequence and cancer-specific TCRalpha read sequence in cancer patients
CVVSAESGGYNKLILE

SEQ ID NO: 1860 - protein, 16 aa, Homo sapiens
  Duplicated TCRalpha strand read sequence and cancer-specific TCRalpha read sequence in cancer patients
CVVSAESGGYNKLIFG

SEQ ID NO: 1861 - protein, 15 aa, Homo sapiens
  Duplicated TCRbeta strand read sequence and cancer-specific TCRbeta read sequence in cancer patients
CSAREPGGGREQFFG

SEQ ID NO: 1862 - protein, 15 aa, Homo sapiens
  Duplicated TCRbeta strand read sequence and cancer-specific TCRbeta read sequence in cancer patients
CASSLAGGPYEQYFG

SEQ ID NO: 1863 - protein, 16 aa, Homo sapiens
  Duplicated TCRbeta strand read sequence and cancer-specific TCRbeta read sequence in cancer patients
CASSVDGDSYNEQFFG

SEQ ID NO: 1864 - protein, 12 aa, Homo sapiens
  Duplicated TCRbeta strand read sequence and cancer-specific TCRbeta read sequence in cancer patients
CASSSTDTQYFG

SEQ ID NO: 1865 - protein, 15 aa, Homo sapiens
  Duplicated TCRbeta strand read sequence and cancer-specific TCRbeta read sequence in cancer patients
CASSLSGDNSPLHFG

SEQ ID NO: 1866 - protein, 12 aa, Homo sapiens
  Duplicated TCRbeta strand read sequence and cancer-specific TCRbeta read sequence in cancer patients
CASSSGNTIYFG

SEQ ID NO: 1867 - protein, 12 aa, Homo sapiens
  Duplicated TCRbeta strand read sequence and cancer-specific TCRbeta read sequence in cancer patients
CASSPRGELFFG

SEQ ID NO: 1868 - protein, 18 aa, Homo sapiens
  Duplicated TCRbeta strand read sequence and cancer-specific TCRbeta read sequence in cancer patients
CASSRMGQGVGGNTIYFG

SEQ ID NO: 1869 - protein, 17 aa, Homo sapiens
  Duplicated TCRbeta strand read sequence and cancer-specific TCRbeta read sequence in cancer patients
CASSQRTSGITNEQFFG

SEQ ID NO: 1870 - protein, 14 aa, Homo sapiens
  Duplicated TCRbeta strand read sequence and cancer-specific TCRbeta read sequence in cancer patients
CASSLIGAGELFFW

SEQ ID NO: 1871 - protein, 13 aa, Homo sapiens
  Duplicated TCRbeta strand read sequence and cancer-specific TCRbeta read sequence in cancer patients
CASSTSSDTQYFW

SEQ ID NO: 1872 - protein, 16 aa, Homo sapiens
  Duplicated TCRbeta strand read sequence and cancer-specific TCRbeta read sequence in cancer patients
CASSYGMGVNTEAFFG

SEQ ID NO: 1873 - protein, 13 aa, Homo sapiens
  Duplicated TCRbeta strand read sequence and cancer-specific TCRbeta read sequence in cancer patients
CASSIQGYEQYFG

SEQ ID NO: 1874 - protein, 14 aa, Homo sapiens
  Duplicated TCRbeta strand read sequence and cancer-specific TCRbeta read sequence in cancer patients
CASGWASTDTQYFG

SEQ ID NO: 1875 - protein, 15 aa, Homo sapiens
  Duplicated TCRbeta strand read sequence and cancer-specific TCRbeta read sequence in cancer patients
CASSYGASSYEQYFG

SEQ ID NO: 1876 - protein, 15 aa, Homo sapiens
  Duplicated TCRbeta strand read sequence and cancer-specific TCRbeta read sequence in cancer patients
CASSYTAKKETQYFG

SEQ ID NO: 1877 - protein, 15 aa, Homo sapiens
  Duplicated TCRbeta strand read sequence and cancer-specific TCRbeta read sequence in cancer patients
CASSASLAGYEQYFG

SEQ ID NO: 1878 - protein, 16 aa, Homo sapiens
  Duplicated TCRbeta strand read sequence and cancer-specific TCRbeta read sequence in cancer patients
CASSHNTGTGNEQFFG

SEQ ID NO: 1879 - protein, 16 aa, Homo sapiens
  Duplicated TCRbeta strand read sequence and cancer-specific TCRbeta read sequence in cancer patients
CASSQDRSRVYGYTFG

SEQ ID NO: 1880 - protein, 13 aa, Homo sapiens
  Duplicated TCRbeta strand read sequence and cancer-specific TCRbeta read sequence in cancer patients
CASSQDVYGYTFG

SEQ ID NO: 1881 - protein, 15 aa, Homo sapiens
  Duplicated TCRbeta strand read sequence and cancer-specific TCRbeta read sequence in cancer patients
CASSQDLGVLRAVLR

SEQ ID NO: 1882 - protein, 15 aa, Homo sapiens
  Duplicated TCRbeta strand read sequence and cancer-specific TCRbeta read sequence in cancer patients
CASSLAQDYNEQFFG

SEQ ID NO: 1883 - protein, 14 aa, Homo sapiens
  Duplicated TCRbeta strand read sequence and cancer-specific TCRbeta read sequence in cancer patients
CASSQAPGQGAHFG

SEQ ID NO: 1884 - protein, 14 aa, Homo sapiens
  Duplicated TCRbeta strand read sequence and cancer-specific TCRbeta read sequence in cancer patients
CSVAAGVNYEQYFG

SEQ ID NO: 1885 - protein, 17 aa, Homo sapiens
  Duplicated TCRbeta strand read sequence and cancer-specific TCRbeta read sequence in cancer patients
CSVRPGTSGRGNEQFFG

SEQ ID NO: 1886 - protein, 15 aa, Homo sapiens
  Duplicated TCRbeta strand read sequence and cancer-specific TCRbeta read sequence in cancer patients
CSVLREITYNEQFFG

SEQ ID NO: 1887 - protein, 13 aa, Homo sapiens
  Duplicated TCRbeta strand read sequence and cancer-specific TCRbeta read sequence in cancer patients
CSVEPGAREQFFG

SEQ ID NO: 1888 - protein, 12 aa, Homo sapiens
  Duplicated TCRbeta strand read sequence and cancer-specific TCRbeta read sequence in cancer patients
CSVDLYNEQFFG

SEQ ID NO: 1889 - protein, 15 aa, Homo sapiens
  Duplicated TCRbeta strand read sequence and cancer-specific TCRbeta read sequence in cancer patients
CSAMLTGGGNEQFFG

SEQ ID NO: 1890 - protein, 11 aa, Homo sapiens
  Duplicated TCRbeta strand read sequence and cancer-specific TCRbeta read sequence in cancer patients
CASGQETQYFG

SEQ ID NO: 1891 - protein, 20 aa, Homo sapiens
  Duplicated TCRbeta strand read sequence and cancer-specific TCRbeta read sequence in cancer patients
CATSDLSGGSRSSYNEQFFG

SEQ ID NO: 1892 - protein, 13 aa, Homo sapiens
  Duplicated TCRbeta strand read sequence and cancer-specific TCRbeta read sequence in cancer patients
CSAPGGNLRAVLR

SEQ ID NO: 1893 - protein, 17 aa, Homo sapiens
  Duplicated TCRbeta strand read sequence and cancer-specific TCRbeta read sequence in cancer patients
CSAWDFTNSGANVLTFG

SEQ ID NO: 1894 - protein, 14 aa, Homo sapiens
  Duplicated TCRbeta strand read sequence and cancer-specific TCRbeta read sequence in cancer patients
CSARGRWAETQYFG

SEQ ID NO: 1895 - protein, 13 aa, Homo sapiens
  Duplicated TCRbeta strand read sequence and cancer-specific TCRbeta read sequence in cancer patients
CSAKQASETQYFG

SEQ ID NO: 1896 - protein, 16 aa, Homo sapiens
  Duplicated TCRbeta strand read sequence and cancer-specific TCRbeta read sequence in cancer patients
CSARDWRGAKNIQYFG

SEQ ID NO: 1897 - protein, 15 aa, Homo sapiens
  Duplicated TCRbeta strand read sequence and cancer-specific TCRbeta read sequence in cancer patients
CASSMIREYNEQFFG

SEQ ID NO: 1898 - protein, 15 aa, Homo sapiens
  Duplicated TCRbeta strand read sequence and cancer-specific TCRbeta read sequence in cancer patients
CASSITSASYEQFFG

SEQ ID NO: 1899 - protein, 16 aa, Homo sapiens
  Duplicated TCRbeta strand read sequence and cancer-specific TCRbeta read sequence in cancer patients
CASSILGNGNQPQHFG

SEQ ID NO: 1900 - protein, 15 aa, Homo sapiens
  Duplicated TCRbeta strand read sequence and cancer-specific TCRbeta read sequence in cancer patients
CASSIERGIYGYTFG

SEQ ID NO: 1901 - protein, 14 aa, Homo sapiens
  Duplicated TCRbeta strand read sequence and cancer-specific TCRbeta read sequence in cancer patients
CASSPLNEYEQYFG

SEQ ID NO: 1902 - protein, 15 aa, Homo sapiens
  Duplicated TCRbeta strand read sequence and cancer-specific TCRbeta read sequence in cancer patients
CASSMGTGTYEQYFG

SEQ ID NO: 1903 - protein, 15 aa, Homo sapiens
  Duplicated TCRbeta strand read sequence and cancer-specific TCRbeta read sequence in cancer patients
CASSFSAPKPTPLSL

SEQ ID NO: 1904 - protein, 14 aa, Homo sapiens
  Duplicated TCRbeta strand read sequence and cancer-specific TCRbeta read sequence in cancer patients
CASSLRANTEAFFG

SEQ ID NO: 1905 - protein, 13 aa, Homo sapiens
  Duplicated TCRbeta strand read sequence and cancer-specific TCRbeta read sequence in cancer patients
CASSSAGDTQYFW

SEQ ID NO: 1906 - protein, 15 aa, Homo sapiens
  Duplicated TCRbeta strand read sequence and cancer-specific TCRbeta read sequence in cancer patients
CASSRRQGAYEQYFG

SEQ ID NO: 1907 - protein, 13 aa, Homo sapiens
  Duplicated TCRbeta strand read sequence and cancer-specific TCRbeta read sequence in cancer patients
CASSLPGYGYTFG

SEQ ID NO: 1908 - protein, 19 aa, Homo sapiens
  Duplicated TCRbeta strand read sequence and cancer-specific TCRbeta read sequence in cancer patients
CAISERRIAGTSTDTQYFG

SEQ ID NO: 1909 - protein, 15 aa, Homo sapiens
  Duplicated TCRbeta strand read sequence and cancer-specific TCRbeta read sequence in cancer patients
CAISEFAGPEGYTFG

SEQ ID NO: 1910 - DNA, 85 bp, artificial sequence
  P5-P20EA primer sequence
aatgatacggcgaccaccgagatctacacatcacgactctttccctacacgacgctcttccgatcttaatacgactccgaattcc

SEQ ID NO: 1911 - DNA, 85 bp, artificial sequence
  P5-P20EA primer sequence
aatgatacggcgaccaccgagatctacacacagtggttctttccctacacgacgctcttccgatcttaatacgactccgaattcc

SEQ ID NO: 1912 - DNA, 85 bp, artificial sequence
  P5-P20EA primer sequence
aatgatacggcgaccaccgagatctacaccagatccatctttccctacacgacgctcttccgatcttaatacgactccgaattcc

SEQ ID NO: 1913 - DNA, 85 bp, artificial sequence
  P5-P20EA primer sequence
aatgatacggcgaccaccgagatctacacacaaacggtctttccctacacgacgctcttccgatcttaatacgactccgaattcc

SEQ ID NO: 1914 - DNA, 85 bp, artificial sequence
  P5-P20EA primer sequence
aatgatacggcgaccaccgagatctacacacccagcatctttccctacacgacgctcttccgatcttaatacgactccgaattcc

SEQ ID NO: 1915 - DNA, 85 bp, artificial sequence
  P5-P20EA primer sequence
aatgatacggcgaccaccgagatctacacaacccctctctttccctacacgacgctcttccgatcttaatacgactccgaattcc

SEQ ID NO: 1916 - DNA, 85 bp, artificial sequence
  P5-P20EA primer sequence
aatgatacggcgaccaccgagatctacaccccaaccttctttccctacacgacgctcttccgatcttaatacgactccgaattcc

SEQ ID NO: 1917 - DNA, 85 bp, artificial sequence
  P5-P20EA primer sequence
aatgatacggcgaccaccgagatctacaccaccacactctttccctacacgacgctcttccgatcttaatacgactccgaattcc

SEQ ID NO: 1918 - DNA, 85 bp, artificial sequence
  P5-P20EA primer sequence
aatgatacggcgaccaccgagatctacacgaaacccatctttccctacacgacgctcttccgatcttaatacgactccgaattcc

SEQ ID NO: 1919 - DNA, 85 bp, artificial sequence
  P5-P20EA primer sequence
aatgatacggcgaccaccgagatctacactgtgaccatctttccctacacgacgctcttccgatcttaatacgactccgaattcc

SEQ ID NO: 1920 - DNA, 85 bp, artificial sequence
  P5-P20EA primer sequence
aatgatacggcgaccaccgagatctacacagggtcaatctttccctacacgacgctcttccgatcttaatacgactccgaattcc

SEQ ID NO: 1921 - DNA, 85 bp, artificial sequence
  P5-P20EA primer sequence
aatgatacggcgaccaccgagatctacacaggagtggtctttccctacacgacgctcttccgatcttaatacgactccgaattcc

SEQ ID NO: 1922 - DNA, 89 bp, artificial sequence
  P7-CA3 primer sequence
caagcagaagacggcatacgagattgaaccttgtgactggagttcagacgtgtgctcttccgatctataggcagacagacttgtcactg

SEQ ID NO: 1923 - DNA, 89 bp, artificial sequence
  P7-CA3 primer sequence
caagcagaagacggcatacgagattgctaagtgtgactggagttcagacgtgtgctcttccgatctataggcagacagacttgtcactg

SEQ ID NO: 1924 - DNA, 89 bp, artificial sequence
  P7-CA3 primer sequence
caagcagaagacggcatacgagattgttctctgtgactggagttcagacgtgtgctcttccgatctataggcagacagacttgtcactg

SEQ ID NO: 1925 - DNA, 89 bp, artificial sequence
  P7-CA3 primer sequence
caagcagaagacggcatacgagattaagacacgtgactggagttcagacgtgtgctcttccgatctataggcagacagacttgtcactg

SEQ ID NO: 1926 - DNA, 89 bp, artificial sequence
  P7-CA3 primer sequence
caagcagaagacggcatacgagatctaatcgagtgactggagttcagacgtgtgctcttccgatctataggcagacagacttgtcactg

SEQ ID NO: 1927 - DNA, 89 bp, artificial sequence
  P7-CA3 primer sequence
caagcagaagacggcatacgagatctagaacagtgactggagttcagacgtgtgctcttccgatctataggcagacagacttgtcactg

SEQ ID NO: 1928 - DNA, 89 bp, artificial sequence
  P7-CA3 primer sequence
caagcagaagacggcatacgagattaagttccgtgactggagttcagacgtgtgctcttccgatctataggcagacagacttgtcactg

SEQ ID NO: 1929 - DNA, 89 bp, artificial sequence
  P7-CA3 primer sequence
caagcagaagacggcatacgagattagacctagtgactggagttcagacgtgtgctcttccgatctataggcagacagacttgtcactg

SEQ ID NO: 1930 - DNA, 89 bp, artificial sequence
  P7-CB3 primer sequence
caagcagaagacggcatacgagattgaaccttgtgactggagttcagacgtgtgctcttccgatctacaccagtgtggccttttgggtg

SEQ ID NO: 1931 - DNA, 89 bp, artificial sequence
  P7-CB3 primer sequence
caagcagaagacggcatacgagattgctaagtgtgactggagttcagacgtgtgctcttccgatctacaccagtgtggccttttgggtg

SEQ ID NO: 1932 - DNA, 89 bp, artificial sequence
  P7-CB3 primer sequence
caagcagaagacggcatacgagattgttctctgtgactggagttcagacgtgtgctcttccgatctacaccagtgtggccttttgggtg

SEQ ID NO: 1933 - DNA, 89 bp, artificial sequence
  P7-CB3 primer sequence
caagcagaagacggcatacgagattaagacacgtgactggagttcagacgtgtgctcttccgatctacaccagtgtggccttttgggtg

SEQ ID NO: 1934 - DNA, 89 bp, artificial sequence
  P7-CB3 primer sequence
caagcagaagacggcatacgagatctaatcgagtgactggagttcagacgtgtgctcttccgatctacaccagtgtggccttttgggtg

SEQ ID NO: 1935 - DNA, 89 bp, artificial sequence
  P7-CB3 primer sequence
caagcagaagacggcatacgagatctagaacagtgactggagttcagacgtgtgctcttccgatctacaccagtgtggccttttgggtg

SEQ ID NO: 1936 - DNA, 89 bp, artificial sequence
  P7-CB3 primer sequence
caagcagaagacggcatacgagattaagttccgtgactggagttcagacgtgtgctcttccgatctacaccagtgtggccttttgggtg

SEQ ID NO: 1937 - DNA, 89 bp, artificial sequence
  P7-CB3 primer sequence
caagcagaagacggcatacgagattagacctagtgactggagttcagacgtgtgctcttccgatctacaccagtgtggccttttgggtg

SEQ ID NO: 1938 - protein, 12 aa, Homo sapiens
  Invariant TCRs observed in public TRA sequences
CAVRDSNYQLIW

SEQ ID NO: 1939 - protein, 12 aa, Homo sapiens
  Invariant TCRs observed in public TRA sequences
CAVRDSNYQLIW

SEQ ID NO: 1940 - protein, 12 aa, Homo sapiens
  Invariant TCRs observed in public TRA sequences
CAVLDSNYQLIW

SEQ ID NO: 1941 - protein, 12 aa, Homo sapiens
  Invariant TCRs observed in public TRA sequences
CAVMDSSYKLIF

SEQ ID NO: 1942 - protein, 12 aa, Homo sapiens
  Invariant TCRs observed in public TRA sequences
CAVTDSNYQLIW

SEQ ID NO: 1943 - protein, 12 aa, Homo sapiens
  Invariant TCRs observed in public TRA sequences
CAVRDGDYKLSF

SEQ ID NO: 1944 - protein, 12 aa, Homo sapiens
  Invariant TCRs observed in public TRA sequences
CAVKDSNYQLIW

SEQ ID NO: 1945 - protein, 12 aa, Homo sapiens
  Invariant TCRs observed in public TRA sequences
CAAMDSNYQLIW

SEQ ID NO: 1946 - protein, 12 aa, Homo sapiens
  Invariant TCRs observed in public TRA sequences
CAALDSNYQLIW

SEQ ID NO: 1947 - protein, 10 aa, Homo sapiens
  Invariant TCRs observed in public TRA sequences
CALNDYKLSF

SEQ ID NO: 1948 - protein, 12 aa, Homo sapiens
  Invariant TCRs observed in public TRA sequences
CAVVDSNYQLIW

SEQ ID NO: 1949 - protein, 15 aa, Homo sapiens
  Invariant TCRs observed in public TRA sequences
CVVSDRGSTLGRLYF

SEQ ID NO: 1950 - protein, 12 aa, Homo sapiens
  Invariant TCRs observed in public TRA sequences
CAVIDSNYQLIW

SEQ ID NO: 1951 - protein, 12 aa, Homo sapiens
  Invariant TCRs observed in public TRA sequences
CAENTGGFKTIF

SEQ ID NO: 1952 - protein, 12 aa, Homo sapiens
  Invariant TCRs observed in public TRA sequences
CAVSDSNYQLIW

SEQ ID NO: 1953 - protein, 13 aa, Homo sapiens
  Invariant TCRs observed in public TRA sequences
CALSGGSNYKLTF

SEQ ID NO: 1954 - protein, 14 aa, Homo sapiens
  Invariant TCRs observed in public TRA sequences
CAVEDQTGANNLFF

SEQ ID NO: 1955 - protein, 15 aa, Homo sapiens
  Invariant TCRs observed in public TRA sequences
CALSDSGGGADGLTF

SEQ ID NO: 1956 - protein, 12 aa, Homo sapiens
  Invariant TCRs observed in public TRA sequences
CAVRDRDYKLSF

SEQ ID NO: 1957 - protein, 12 aa, Homo sapiens
  Invariant TCRs observed in public TRA sequences
CAVRDRDYKLSF

SEQ ID NO: 1958 - protein, 10 aa, Homo sapiens
  Invariant TCRs observed in public TRA sequences
CAVNDYKLSF

SEQ ID NO: 1959 - protein, 12 aa, Homo sapiens
  Invariant TCRs observed in public TRA sequences
CAPMDSNYQLIW

SEQ ID NO: 1960 - protein, 12 aa, Homo sapiens
  Invariant TCRs observed in public TRA sequences
CASMDSNYQLIW

SEQ ID NO: 1961 - protein, 11 aa, Homo sapiens
  Invariant TCRs observed in public TRA sequences
CAVNRDDKIIF

SEQ ID NO: 1962 - protein, 14 aa, Homo sapiens
  Invariant TCRs observed in public TRA sequences
CAENSGGSNYKLTF

SEQ ID NO: 1963 - protein, 12 aa, Homo sapiens
  Invariant TCRs observed in public TRA sequences
CAPLDSNYQLIW

SEQ ID NO: 1964 - protein, 14 aa, Homo sapiens
  Invariant TCRs observed in public TRA sequences
CALNSGGSNYKLTF

SEQ ID NO: 1965 - protein, 10 aa, Homo sapiens
  Invariant TCRs observed in public TRA sequences
CVVNDYKLSF

SEQ ID NO: 1966 - protein, 12 aa, Homo sapiens
  Invariant TCRs observed in public TRA sequences
CALSSNDYKLSF

SEQ ID NO: 1967 - protein, 13 aa, Homo sapiens
  Invariant TCRs observed in public TRA sequences
CAASNQAGTALIF

SEQ ID NO: 1968 - protein, 11 aa, Homo sapiens
  Invariant TCRs observed in public TRA sequences
CVVNTGNQFYF

SEQ ID NO: 1969 - protein, 12 aa, Homo sapiens
  Invariant TCRs observed in public TRA sequences
CVVNTNAGKSTF

SEQ ID NO: 1970 - protein, 13 aa, Homo sapiens
  Invariant TCRs observed in public TRA sequences
CAVEDTGGFKTIF

SEQ ID NO: 1971 - protein, 12 aa, Homo sapiens
  Invariant TCRs observed in public TRA sequences
CAVEDSNYQLIW

SEQ ID NO: 1972 - protein, 12 aa, Homo sapiens
  Invariant TCRs observed in public TRA sequences
CAVDNYGQNFVF

SEQ ID NO: 1973 - protein, 15 aa, Homo sapiens
  Invariant TCRs observed in public TRA sequences
CALSDSGGSNYKLTF

SEQ ID NO: 1974 - protein, 12 aa, Homo sapiens
  Invariant TCRs observed in public TRA sequences
CAVMDSSYKLIF

SEQ ID NO: 1975 - protein, 12 aa, Homo sapiens
  Invariant TCRs observed in public TRA sequences
CAVNTGGFKTIF

SEQ ID NO: 1976 - protein, 12 aa, Homo sapiens
  Invariant TCRs observed in public TRA sequences
CAVRDGNYQLIW

SEQ ID NO: 1977 - protein, 12 aa, Homo sapiens
  Invariant TCRs observed in public TRA sequences
CALNTGFQKLVF

SEQ ID NO: 1978 - protein, 13 aa, Homo sapiens
  Invariant TCRs observed in public TRA sequences
CAENTGTASKLTF

SEQ ID NO: 1979 - protein, 12 aa, Homo sapiens
  Invariant TCRs observed in public TRA sequences
CAATDSNYQLIW

SEQ ID NO: 1980 - protein, 12 aa, Homo sapiens
  Invariant TCRs observed in public TRA sequences
CAVNQAGTALIF

SEQ ID NO: 1981 - protein, 14 aa, Homo sapiens
  Invariant TCRs observed in public TRA sequences
CAENYGGSQGNLIF

SEQ ID NO: 1982 - protein, 12 aa, Homo sapiens
  Invariant TCRs observed in public TRA sequences
CAVLNRDDKIIF

SEQ ID NO: 1983 - protein, 13 aa, Homo sapiens
  Invariant TCRs observed in public TRA sequences
CAVEDNYGQNFVF

SEQ ID NO: 1984 - protein, 10 aa, Homo sapiens
  Invariant TCRs observed in public TRA sequences
CAVNDYKLSF

SEQ ID NO: 1985 - protein, 10 aa, Homo sapiens
  Invariant TCRs observed in public TRA sequences
CVVNNARLMF

SEQ ID NO: 1986 - protein, 12 aa, Homo sapiens
  Invariant TCRs observed in public TRA sequences
CAVDNYGQNFVF

SEQ ID NO: 1987 - protein, 12 aa, Homo sapiens
  Invariant TCRs observed in public TRA sequences
CAVDSSASKIIF

SEQ ID NO: 1988 - protein, 13 aa, Homo sapiens
  Invariant TCRs observed in public TRA sequences
CALIYNQGGKLIF

SEQ ID NO: 1989 - protein, 12 aa, Homo sapiens
  Invariant TCRs observed in public TRA sequences
CALNTGGFKTIF

SEQ ID NO: 1990 - protein, 12 aa, Homo sapiens
  Invariant TCRs observed in public TRA sequences
CALNTGGFKTIF

SEQ ID NO: 1991 - protein, 12 aa, Homo sapiens
  Invariant TCRs observed in public TRA sequences
CAVLDSSYKLIF

SEQ ID NO: 1992 - protein, 12 aa, Homo sapiens
  Invariant TCRs observed in public TRA sequences
CAAMDSSYKLIF

The invention claimed is:

1. A method of quantitatively analyzing a repertoire of a variable region of a T cell receptor (TCR) or a B cell receptor (BCR) of a subject, wherein the method comprises:
  (1) providing a nucleic acid sample comprising a nucleic acid sequence of the T cell receptor (TCR) or the B cell receptor (BCR) which is amplified from the subject in an unbiased manner, wherein the step (1) comprises the following steps:
    (1-1) synthesizing a complementary DNA by using an RNA sample derived from a target cell as a template;
    (1-2) synthesizing a double stranded complementary DNA by using the complementary DNA as a template;
    (1-3) attaching a double stranded common adaptor primer sequence to the double stranded complementary DNA to synthesize an adaptor-added double stranded complementary DNA;
    (1-4) performing a first PCR amplification reaction by using the adaptor-added double stranded complementary DNA, a common adaptor primer consisting of the common adaptor primer sequence, and a first TCR or BCR C region specific primer,
      wherein the first TCR or BCR C region specific primer is designed to comprise a sequence that is sufficiently specific to a C region of interest of the TCR or BCR for a gene amplification reaction and not homologous with other genetic sequences, and anneals to a position upstream of a mismatching base between subtypes during said first PCR amplification reaction;
    (1-5) performing a second PCR amplification reaction by using a PCR amplicon of (1-4), the common adaptor primer, and a second TCR or BCR C region specific primer,
      wherein the second TCR or BCR C region specific primer is designed to have a sequence that is a complete match with the TCR or BCR C region in a sequence downstream the sequence of the first TCR or BCR C region specific primer, but comprise a sequence that is not homologous with other genetic sequences, and anneal to a position upstream of a mismatching base between subtypes during said second PCR amplification reaction; and
    (1-6) performing a third PCR amplification reaction by using a PCR amplicon of (1-5), an added common adaptor primer in which a nucleic acid sequence of the common adaptor primer comprises a first additional adaptor nucleic acid sequence, and an adaptor-added third TCR or BCR C region specific primer in which a second additional adaptor nucleic acid sequence and a molecule identification (MID Tag) sequence are added to a third TCR or BCR C region specific sequence;
      wherein the third TCR or BCR C region specific primer is designed to have a sequence that is a complete match with the TCR or BCR C region in a sequence downstream to the sequence of the second TCR or BCR C region specific primer, but comprise a sequence that is not homologous with other genetic sequences, and anneal to a position upstream of a mismatching base between subtypes during said third PCR amplification reaction,
      the first additional adaptor nucleic acid sequence is a sequence suitable for binding to a DNA capturing bead and for an emPCR reaction,
      the second additional adaptor nucleic acid sequence is a sequence suitable for an emPCR reaction, and
      the molecule identification (MID Tag) sequence is a sequence for imparting uniqueness such that an amplicon can be identified;
  (2) determining the nucleic acid sequence comprised in the nucleic acid sample; and
  (3) calculating a frequency of appearance of each gene or a combination thereof based on the determined nucleic acid sequence to derive a TCR or BCR repertoire of the subject,
  wherein the method allows detection of the variable region usage frequency between subtypes.

2. The method of claim 1, wherein the nucleic acid sample comprises nucleic acid sequences of a plurality of types of T cell receptors (TCR) or B cell receptors (BCR) and the step (2) determines the nucleic acid sequence by a single sequencing.

3. The method of claim 2, wherein the single sequencing is characterized in that at least one of the sequences used as a primer in amplification from the nucleic acid sample into a sample for sequencing has the same sequence as a nucleic acid sequence encoding a C region or a complementary strand thereof.

4. The method of claim 3, wherein the single sequencing is characterized in being performed with a common adaptor primer.

5. The method of claim 1, wherein the unbiased amplification is not V region specific amplification.

6. The method of claim 1, wherein the repertoire is the repertoire of a variable region of a BCR, and the nucleic acid sequence is a BCR nucleic acid sequence.

7. The method of claim 1, wherein (3) derivation of the TCR or BCR repertoire is accomplished by a method comprising the following steps:
  (3-1) providing a reference database for each gene region comprising at least one of a V region, a D region, a J region and optionally a C region;
  (3-2) providing an input sequence set which is optionally trimmed and optionally extracted to have a suitable length;

(3-3) searching for homology of the input sequence set with the reference database for the each gene region and recording an alignment with an approximate reference allele and/or a sequence of the reference allele;

(3-4) assigning the V region and the J region for the input sequence set and extracting a nucleic acid sequence of the D region based on a result of assigning;

(3-5) translating the nucleic acid sequence of the D region into an amino acid sequence and classifying the D region by utilizing the amino acid sequence; and (3-6) calculating a frequency of appearance for each of the V region, the D region, and the J region and optionally the C region or a frequency of appearance of a combination thereof based on the classifying in (3-5) to derive the TCR or BCR repertoire.

8. A method of quantitatively analyzing a repertoire of a variable region of a T cell receptor (TCR) or a B cell receptor (BCR) of a subject, wherein the method comprises:

(1) providing a nucleic acid sample comprising a nucleic acid sequence of the T cell receptor (TCR) or the B cell receptor (BCR) which is amplified from the subject in an unbiased manner, wherein the step (1) comprises the following steps:

(1-1) synthesizing a complementary DNA by using an RNA sample derived from a target cell as a template;

(1-2) synthesizing a double stranded complementary DNA by using the complementary DNA as a template;

(1-3) attaching a double stranded common adaptor primer sequence to the double stranded complementary DNA to synthesize an adaptor-added double stranded complementary DNA;

(1-4) performing a first PCR amplification reaction by using the adaptor-added double stranded complementary DNA, a common adaptor primer consisting of the common adaptor primer sequence, and a first TCR or BCR C region specific primer, wherein the first TCR or BCR C region specific primer is designed to comprise a sequence that is sufficiently specific to a C region of interest of the TCR or BCR for a gene amplification reaction and not homologous with other genetic sequences, and anneal to a position upstream of a mismatching base between subtypes during said first PCR amplification reaction;

(1-5) performing a second PCR amplification reaction by using a PCR amplicon of (1-4), the common adaptor primer, and a second TCR or BCR C region specific primer, wherein the second TCR or BCR C region specific primer is designed to have a sequence that is a complete match with the TCR or BCR C region in a sequence downstream the sequence of the first TCR or BCR C region specific primer, but comprise a sequence that is not homologous with other genetic sequences, and anneal to a position upstream of a mismatching base between subtypes during said second PCR amplification reaction; and (1-6) performing a third PCR amplification reaction by using a PCR amplicon of (1-5), an added common adaptor primer in which a nucleic acid sequence of the common adaptor primer comprises a first additional adaptor nucleic acid sequence, and an adaptor-added third TCR or BCR C region specific primer in which a second additional adaptor nucleic acid sequence is added to a third TCR or BCR C region specific sequence;

wherein the third TCR or BCR C region specific primer is designed to have a sequence that is a complete match with the TCR or BCR C region in a sequence downstream to the sequence of the second TCR or BCR C region specific primer, but comprise a sequence that is not homologous with other genetic sequences, and anneal to a position upstream of a mismatching base between subtypes during said third PCR amplification reaction;

(2) determining the nucleic acid sequence comprised in the nucleic acid sample; and (3) calculating a frequency of appearance of each gene or a combination thereof based on the determined nucleic acid sequence to derive a TCR or BCR repertoire of the subject, wherein the method allows detection of the variable region usage frequency between subtypes.

\* \* \* \* \*